(12) United States Patent
Bruenker et al.

(10) Patent No.: US 12,145,994 B2
(45) Date of Patent: *Nov. 19, 2024

(54) BISPECIFIC ANTIGEN BINDING MOLECULES CAPABLE OF SPECIFIC BINDING TO CD40 AND TO FAP

(71) Applicant: Hoffmann-La Roche Inc., Little Falls, NJ (US)

(72) Inventors: Peter Bruenker, Schlieren (CH); Alexander Bujotzek, Penzberg (DE); Harald Duerr, Penzberg (DE); Guy Georges, Penzberg (DE); Christian Klein, Schlieren (CH); Stephane Leclair, Penzberg (DE); Moritz Rapp, Schlieren (CH); Eva Carina Sum, Schlieren (CH); Christine Trumpfheller, Schlieren (CH); Pablo Umaña, Schlieren (CH)

(73) Assignee: Hoffmann-La Roche Inc., Little Falls, NJ (US)

( * ) Notice: Subject to any disclaimer, the term of this patent is extended or adjusted under 35 U.S.C. 154(b) by 124 days.

This patent is subject to a terminal disclaimer.

(21) Appl. No.: 17/179,223

(22) Filed: Feb. 18, 2021

(65) Prior Publication Data

US 2021/0188992 A1    Jun. 24, 2021

Related U.S. Application Data

(63) Continuation of application No. 15/943,821, filed on Apr. 3, 2018, now abandoned.

(30) Foreign Application Priority Data

Apr. 4, 2017  (EP) ..................... 17164725
Feb. 27, 2018  (EP) ..................... 18158751

(51) Int. Cl.
*A61K 39/395* (2006.01)
*A61P 35/00* (2006.01)
*C07K 16/28* (2006.01)
*C07K 16/40* (2006.01)
*A61K 39/00* (2006.01)

(52) U.S. Cl.
CPC .......... *C07K 16/2878* (2013.01); *A61P 35/00* (2018.01); *C07K 16/40* (2013.01); *A61K 39/39558* (2013.01); *A61K 2039/505* (2013.01); *A61K 2039/5154* (2013.01); *A61K 2039/572* (2013.01); *C07K 2317/24* (2013.01); *C07K 2317/31* (2013.01); *C07K 2317/33* (2013.01); *C07K 2317/35* (2013.01); *C07K 2317/52* (2013.01); *C07K 2317/55* (2013.01); *C07K 2317/56* (2013.01); *C07K 2317/565* (2013.01); *C07K 2317/567* (2013.01); *C07K 2317/569* (2013.01); *C07K 2317/64* (2013.01);

*C07K 2317/71* (2013.01); *C07K 2317/75* (2013.01); *C07K 2317/92* (2013.01); *C07K 2317/94* (2013.01)

(58) Field of Classification Search
None
See application file for complete search history.

(56) References Cited

U.S. PATENT DOCUMENTS

| | | |
|---|---|---|
| 7,288,251 B2 | 10/2007 | Bedian et al. |
| 8,303,955 B2 | 11/2012 | Presta et al. |
| 9,011,847 B2 | 4/2015 | Bacac et al. |
| 9,266,938 B2 | 2/2016 | Ast et al. |
| 9,447,159 B2 | 9/2016 | Ast et al. |
| 9,526,797 B2 | 12/2016 | Gerdes et al. |
| 9,926,379 B2 | 3/2018 | Bruenker et al. |
| 10,184,009 B2 | 1/2019 | Ast et al. |
| 10,202,464 B2 | 2/2019 | Ast et al. |
| 10,253,110 B2 | 4/2019 | Bacac et al. |
| 10,316,104 B2 | 6/2019 | Ast et al. |
| 10,323,098 B2 | 6/2019 | Ast et al. |
| 10,392,445 B2 | 8/2019 | Amann et al. |
| 10,464,981 B2 | 11/2019 | Amann et al. |
| 10,526,413 B2 | 1/2020 | Amann et al. |
| 10,577,429 B2 | 3/2020 | Bacac et al. |
| 10,603,360 B2 | 3/2020 | Gerdes et al. |
| 11,111,312 B2 | 9/2021 | Ast et al. |
| 11,130,822 B2 | 9/2021 | Ast et al. |
| 11,242,396 B2 * | 2/2022 | Bruenker ........... C07K 16/2827 |
| 11,267,903 B2 | 3/2022 | Amann et al. |

(Continued)

FOREIGN PATENT DOCUMENTS

WO  2006/128103 A2  11/2006
WO  2009/062125 A1  5/2009

(Continued)

OTHER PUBLICATIONS

Baudino, L., et al., "Crucial Role of Aspartic Acid at Position 265 in the CH2 Domain for Murine IgG2a and IgG2b Fc-Associated Effector Functions" J Immunol 181(9):6664-6669 (Nov. 1, 2008).

(Continued)

*Primary Examiner* — Yunsoo Kim

(74) *Attorney, Agent, or Firm* — Lawrence S. Graham

(57) ABSTRACT

The invention relates to novel bispecific antigen binding molecules, comprising (a) at least one antigen binding domain capable of specific binding to CD40, and (b) at least one antigen binding domain capable of specific binding to a target cell antigen, in particular Fibroblast Activation Protein (FAP), and to methods of producing these molecules and to methods of using the same.

17 Claims, 45 Drawing Sheets

Specification includes a Sequence Listing.

(56) References Cited

U.S. PATENT DOCUMENTS

| | | |
|---|---|---|
| 11,306,154 B2 | 4/2022 | Amann et al. |
| 11,332,545 B2 | 5/2022 | Bacac et al. |
| 11,447,558 B2 | 9/2022 | Ferrara-Koller et al. |
| 2013/0078249 A1 | 3/2013 | Ast et al. |
| 2014/0193405 A1 | 7/2014 | Presta et al. |
| 2014/0370019 A1 | 12/2014 | Bruenker et al. |
| 2014/0377270 A1 | 12/2014 | Moore et al. |
| 2016/0045597 A1 | 2/2016 | Corse et al. |
| 2017/0174786 A1 | 6/2017 | Bacac et al. |
| 2017/0247467 A1 | 8/2017 | Amann et al. |
| 2018/0230215 A1 | 8/2018 | Hofer et al. |
| 2018/0282409 A1 | 10/2018 | Koller et al. |
| 2018/0340030 A1 | 11/2018 | Bruenker et al. |
| 2019/0016771 A1 | 1/2019 | Amann et al. |
| 2019/0185566 A1 | 6/2019 | Koller et al. |
| 2019/0194291 A1 | 6/2019 | Bruenker et al. |
| 2019/0211113 A1 | 7/2019 | Amann et al. |
| 2019/0248877 A1 | 8/2019 | Amann et al. |
| 2019/0322763 A1 | 10/2019 | Ast et al. |
| 2019/0322765 A1 | 10/2019 | Ast et al. |
| 2019/0382507 A1 | 12/2019 | Amann et al. |
| 2020/0071411 A1 | 3/2020 | Amann et al. |
| 2020/0079873 A1 | 3/2020 | Bacac et al. |
| 2020/0190206 A1 | 6/2020 | Koller et al. |
| 2020/0190207 A1 | 6/2020 | Bruenker |
| 2020/0197492 A1 | 6/2020 | Gerdes et al. |
| 2020/0199234 A1 | 6/2020 | Georges et al. |
| 2020/0223925 A1 | 7/2020 | Gasser et al. |
| 2020/0231691 A1 | 7/2020 | Grau-Richards et al. |
| 2020/0247904 A1 | 8/2020 | Amann et al. |
| 2020/0270321 A1 | 8/2020 | Amann et al. |
| 2020/0277392 A1 | 9/2020 | Amann et al. |
| 2020/0317774 A1 | 10/2020 | Hofer et al. |
| 2020/0325225 A1 | 10/2020 | Bacac et al. |
| 2020/0325238 A1 | 10/2020 | Bacac et al. |
| 2020/0347115 A1 | 11/2020 | Duerr et al. |
| 2020/0392237 A1 | 12/2020 | Bacac et al. |
| 2021/0009656 A1 | 1/2021 | Bruenker et al. |
| 2021/0024610 A1 | 1/2021 | Koller et al. |
| 2021/0054021 A1 | 2/2021 | Deak-Codarri et al. |
| 2021/0070882 A1 | 3/2021 | Bacac et al. |
| 2021/0095002 A1 | 4/2021 | Claus et al. |
| 2021/0163617 A1 | 6/2021 | Ferrara Koller et al. |
| 2021/0188992 A1 | 6/2021 | Bruenker et al. |
| 2021/0253724 A1 | 8/2021 | Claus et al. |
| 2021/0292426 A1 | 9/2021 | Duerr et al. |
| 2021/0324108 A1 | 10/2021 | Amann et al. |
| 2022/0025046 A1 | 1/2022 | Amann et al. |
| 2022/0025069 A1 | 1/2022 | Claus et al. |
| 2022/0242971 A1 | 4/2022 | Ast et al. |
| 2022/0227878 A1 | 7/2022 | Bruenker et al. |
| 2022/0267395 A1 | 8/2022 | Amann et al. |
| 2022/0281995 A1 | 9/2022 | Bacac et al. |
| 2022/0073646 A1 | 10/2022 | Amann et al. |

FOREIGN PATENT DOCUMENTS

| | | |
|---|---|---|
| WO | 2010/145792 A1 | 12/2010 |
| WO | 2012/020006 A2 | 2/2012 |
| WO | 2012/107417 A1 | 8/2012 |
| WO | 2012/130831 A1 | 10/2012 |
| WO | 2013/123061 A1 | 8/2013 |
| WO | 2014/023679 A1 | 2/2014 |
| WO | 2014/180754 A1 | 11/2014 |
| WO | 2014/207064 A1 | 12/2014 |
| WO | 2015/132598 A1 | 9/2015 |
| WO | 2016/30350 A1 | 3/2016 |
| WO | 2016/075278 A1 | 5/2016 |
| WO | 2016/079050 A1 | 5/2016 |
| WO | 2017/025698 A1 | 2/2017 |
| WO | 2017/167714 A1 | 10/2017 |
| WO | 2019/086500 A2 | 5/2019 |
| WO | 2020/007817 A1 | 1/2020 |
| WO | 2020/070035 A1 | 4/2020 |
| WO | 2020/208049 A1 | 10/2020 |
| WO | 2020/260329 A1 | 12/2020 |

OTHER PUBLICATIONS

Bevan et al., "Helping the CD8+ T-Cell Response" Nat.Rev. Immunol. 4(8):595-602 ( 2004).

Bjorck et al., "The CD40 agonistic monoclonal antibody APX005M has potent immune stimulatory capabilities" J. Immunother Cancer 3:P198 ( 2015).

Carbone et al., "A New Mechanism of NK Cell Cytotoxicity Activation: The CD40-CD40 Ligand Interaction" J. Exp. Med. 185(12):2053-2060 ( 1997).

Chen, C., et al., "Enhancement and Destruction of Antibody Function by Somatic Mutation: Unequal Occurrence is Controlled by V Gene Combinatorial Associations" EMBO J 14(12):2784-2794 (Jun. 15, 1995).

Chowdhury et al., "Ex Vivo Assays of Dendritic Cell Activation and Cytokine Profiles as Predictors of In Vivo Effects in an Anti-Human CD40 Monoclonal Antibody ChiLob 7/4 Phase I Trial" Cancer Immunol Res. 2(3):229-240 ( 2013).

Colman, P.M., "Effects of amino acid sequence changes on antibody-antigen interactions" Res Immunol 145(1):33-36 (Jan. 1, 1994).

Dahan et al., "Therapeutic Activity of Agonistic, Human Anti-CD40 Monoclonal Antibodies Requires Selective FcgR Engagement" Cancer Cell 29(6):820-831 ( 2016).

D'Angelo, S., et al., "Many Routes to an Antibody Heavy-Chain CDR3: Necessary, Yet Insufficient, for Specific Binding" Front Immunol 9(395):1-13 (Mar. 8, 2018).

Elgueta et al., "Molecular mechanism and function of CD40/CD40L engagement in the immune system" Immunol. Rev. 229(1):152-172 (May 1, 2009).

Eliopoulos et al., "CD40 Induces Apoptosis in Carcinoma Cells through Activation of Cytotoxic Ligands of the Tumor Necrosis Factor Superfamily" Mol Cell Biol. 20(15):5503-5515 ( 2000).

Gardai et al., "SEA-CD40, a sugar engineered non-fucosylated anti-CD40 antibody with improve immune avtivating capabilities" AACR 106th Annual Meeting Abstract 2472 (Apr. 2015).

International Search Report and Written Opinion Mailed Aug. 14, 2018 for International Application No. PCT/EP2018/058384.

Jefferis, R et al., "IgG-Fc-mediated Effector Functions: Molecular Definition of Interaction Sites for Effector Ligands and the Role of Glycosylation" Immunol Rev 163(1):59-76 (Jun. 1, 1998).

Jefferis, R., "Glycosylation as a strategy to improve antibody-based therapeutics" Nat Rev Drug Discov 8(3):226-234 (Mar. 1, 2009).

Khubchandani et al., "Dacetuzumab, a humanized mAb against CD40 for the treatment of hematological malignancies" Curr. Opin. Invest. Dr. 10(6):579-587 ( 2009).

Kiyoshi, M., et al., "Assessing the Heterogeneity of the Fc-Glycan of a Therapeutic Antibody Using an engineered FcyReceptor IIIa-Immobilized Column" Sci Rep 8(3955):1-11 (Mar. 2, 2018).

Kussie, P., et al., "A Single Engineered Amino Acid Substitution Changes Antibody Fine Specificity" J Immunol 152(1):146-152 (Jan. 1, 1994).

Law et al., "Preclinical Antilymphoma Activity of a Humanized Anti-CD40" Cancer Res. 65(18):8331-8338 ( 2005).

Li, F., et al., "Innhibitory Fcy receptor engagement drives adjuvant and anti-tumor activities of agonistic CD40 antibodies" Science 333((6045)):1030-1034 (Aug. 19, 2011).

Mangsbo et al., "The Human Agonistic CD40 Antibody ADC-1013 Eradicates Bladder Tumors and Generates T-cell-Dependent Tumor Immunity" Clin Cancer Res. 21:1115-1126 ( 2014).

Rudikoff, S., et al., "Single amino acid substitution altering antigen-binding specificity" Pnas USA 79(6): 1979-1983 (Mar. 1, 1982).

Saunders, K., "Conceptual Approaches to Modulating Antibody Effector Functions and Circulation Half-Life" Front Immunol 10(1296):1-20 (Jun. 7, 2019).

Teng et al., "CD1d-Based Combination Therapy Eradicates Established Tumors in Mice1" J. Immunol 183:1911-1920 ( 2009).

Vonderheide et al., "Agonistic CD40 Antibodies and Cancer Therapy" Clin. Cancer Res. 19(5):1035-1043 ( 2013).

(56) References Cited

OTHER PUBLICATIONS

Vonderheide et al., "Clinical Activity and Immune Modulation in Cancer Patients Treated With CP-870,893, a Novel CD40 Agonist Monoclonal Antibody" J. Clin. Oncol. 25(7):876-883 ( 2007).
Wang, X., et al., "IgG Fc engineering to modulate antibody effector functions" Protein Cell 9(1):63-73 (Jan. 1, 2018).
Watts et al., "TNF/TNFR Familymembers in Costimulation of T Cell Responses" Annu. Rev. Immunol 23:23-68 ( 2005).
Wyzgol et al., "Trimer Stabilization, Oligomerization, and Antibody-Mediated Cell Surface Immobilization Improve the Activity of Soluble Trimers of CD27L, CD40L, 41BBL, and Glucocorticoid-Induced TNF Receptor Ligand" J Immunol 183:1851-1861 ( 2009).
U.S. Appl. No. 15/941,519, filed Mar. 30, 2018, Abandoned, US 2018/0230215.
U.S. Appl. No. 16/689,880, filed Nov. 20, 2019, Published, US 2020/0317774.
U.S. Appl. No. 15/281,493, filed Sep. 30, 2016, Abandoned, US 2017/0174786.
U.S. Appl. No. 16/877,150, filed May 18, 2020, Published, US 2021/0070882.
U.S. Appl. No. 15/087,405, filed Mar. 31, 2016, Granted, U.S. Pat. No. 10,464,981.
U.S. Appl. No. 16/653,652, filed Oct. 15, 2019, Published, US 2020/0270321.
U.S. Appl. No. 16/184,147, filed Nov. 8, 2018, Abandoned, US 2019/0194291.
U.S. Appl. No. 17/030,251, filed Sep. 23, 2020, Published, US 2021/0009656.
U.S. Appl. No. 15/763,868, filed Mar. 28, 2018, Published, US 2018/0282409.
16/446,4861, filed Jun. 19, 2019, Published, US 2020/0190206.
U.S. Appl. No. 17/125,533, filed Dec. 17, 2020, Un Published, WO 2020/007817.
U.S. Appl. No. 16/820,504, filed Mar. 16, 2020, Published, US 2020/0325238.
U.S. Appl. No. 17/017,576, filed Sep. 23, 2020, Published, US 2021/0163617.
U.S. Appl. No. 14/940,400, filed Nov. 13, 2015, Un Published, WO 2016/075278.
U.S. Appl. No. 15/067,024, filed Mar. 10, 2016, Granted, U.S. Pat. No. 10,392,445.
U.S. Appl. No. 16/522,391, filed Jul. 25, 2019, Published, US 2020/0247904 A1.
U.S. Appl. No. 16/522,412, filed Jul. 25, 2019, Published, US 2019/0382507 A1.
U.S. Appl. No. 15/280,379, filed Sep. 29, 2016, Granted, U.S. Pat. No. 10,526,413.
U.S. Appl. No. 16/684,258, filed Nov. 14, 2019, Published, US 2020/0071411 A1.
U.S. Appl. No. 15/280,386, filed Sep. 29, 2016, Abandoned, US 2017/0247467 A1.
U.S. Appl. No. 16/218,266, filed Dec. 12, 2018, Published, US 2019/021113.
U.S. Appl. No. 16/760,820, filed Apr. 30, 2020, Un Published, WO 2019/086500.
U.S. Appl. No. 16/144,687, filed Sep. 27, 2018, Abandoned, US 2019/0016771 A1.
U.S. Appl. No. 16/861,801, filed Apr. 29, 2020, Published, US 2020/0347115 A1.
U.S. Appl. No. 16/825,773, filed Mar. 20, 2020, Published, US 2020/0325225 A1.
U.S. Appl. No. 17/017,942, filed Sep. 19, 2020, Published, US 2021/0095002 A1.
U.S. Appl. No. 17/066,711, filed Oct. 9, 2020, Published, US 2021/0024610 A1, WO 2019/197600.
WO 2020/260329.
U.S. Appl. No. 16/186,443, filed Nov. 9, 2018, Published, US 2019/0248877.
U.S. Appl. No. 16/584,931, filed Sep. 26, 2019, Published, US 2020/0277392 A1.
U.S. Appl. No. 16/581,756, filed Sep. 25, 2019, Published, US 2020/0231691 A1.
U.S. Appl. No. 16/189,041, filed Nov. 13, 2018, Published, US 2019/0185566.
U.S. Appl. No. 13/205,743, filed Aug. 9, 2011, Granted, U.S. Pat. No. 9,011,847.
U.S. Appl. No. 14/661,839, filed Mar. 18, 2015, Granted, U.S. Pat. No. 10,253,110.
U.S. Appl. No. 14/661,833, filed Mar. 18, 2015, Granted, U.S. Pat. No. 10,577,429.
U.S. Appl. No. 16/378,320, filed Apr. 8, 2019, Published, US 2020/0079873.
U.S. Appl. No. 16/860,552, filed Apr. 28, 2020, Published, US 2020/0392237 A1.
U.S. Appl. No. 16/588,780, filed Sep. 30, 2019, Published, US 2020/0190207 A1.
U.S. Appl. No. 17/218,752, filed Mar. 31, 2021, Un Published, WO 2020/070035.
GenBank: AOY40298.1, "immunoglobulin heavy chain variable region, partial [*Homo sapiens*]".
Klein et al., "The use of CrossMAb technology for the generation of bi- and multispecific antibodies" mAbs 8(6):1010-1020 ( 2016).
Kontermann, "Recombinant bispecific antibodies for cancer therapy" Acta Pharmacologica Sinica 26(1):1-9 ( 2005).
Shao, "Trends in research of anti-tumor antibody drugs—Machine Translation in English" Chin. Med. Biotechnol. 9(4):288-290 (2014).
Shao, "Trends in research of anti-tumor antibody drugs" Chin. Med. Biotechnol. 9(4):288-290 (2014).
Unverdorben, F. et al., "Pharmacokinetic properties of IgG and various Fc fusion proteins in mice" MABS 8(1):120-128 (Oct. 29, 2016).

\* cited by examiner

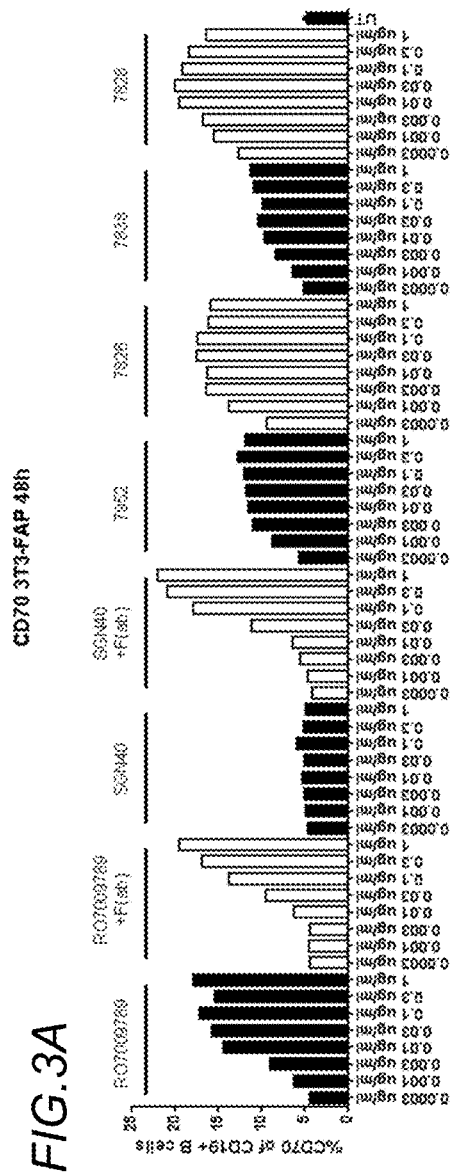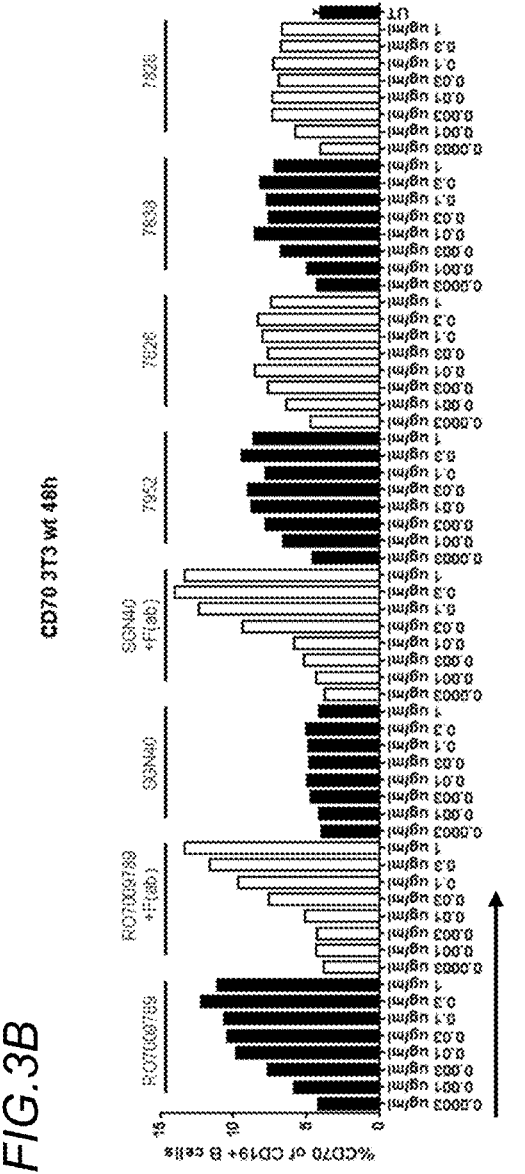

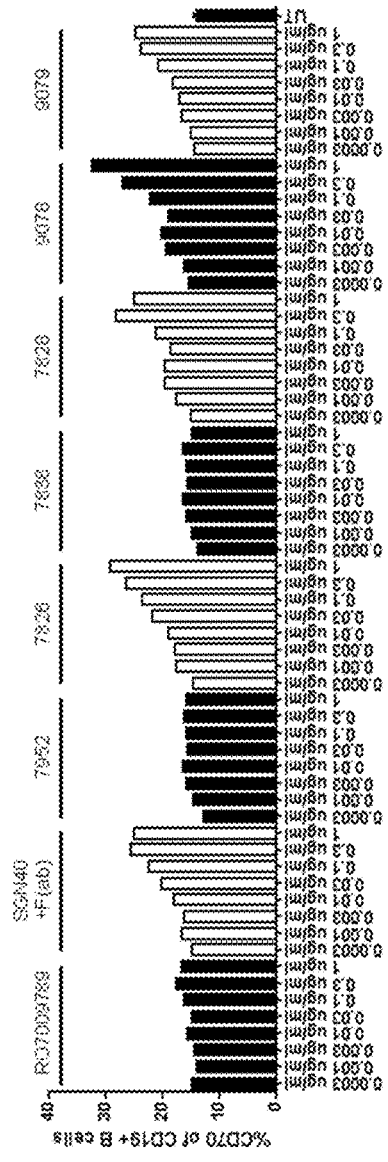
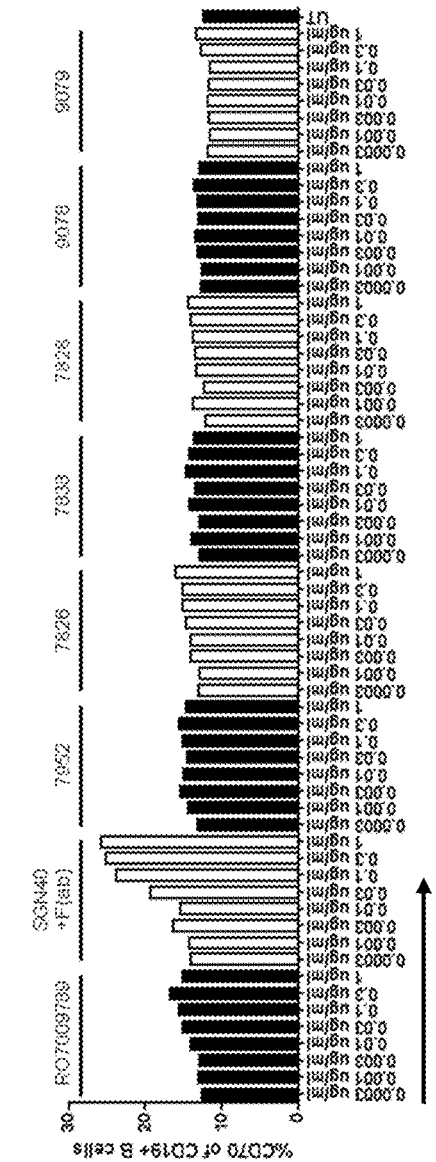
FIG. 4A
FIG. 4B

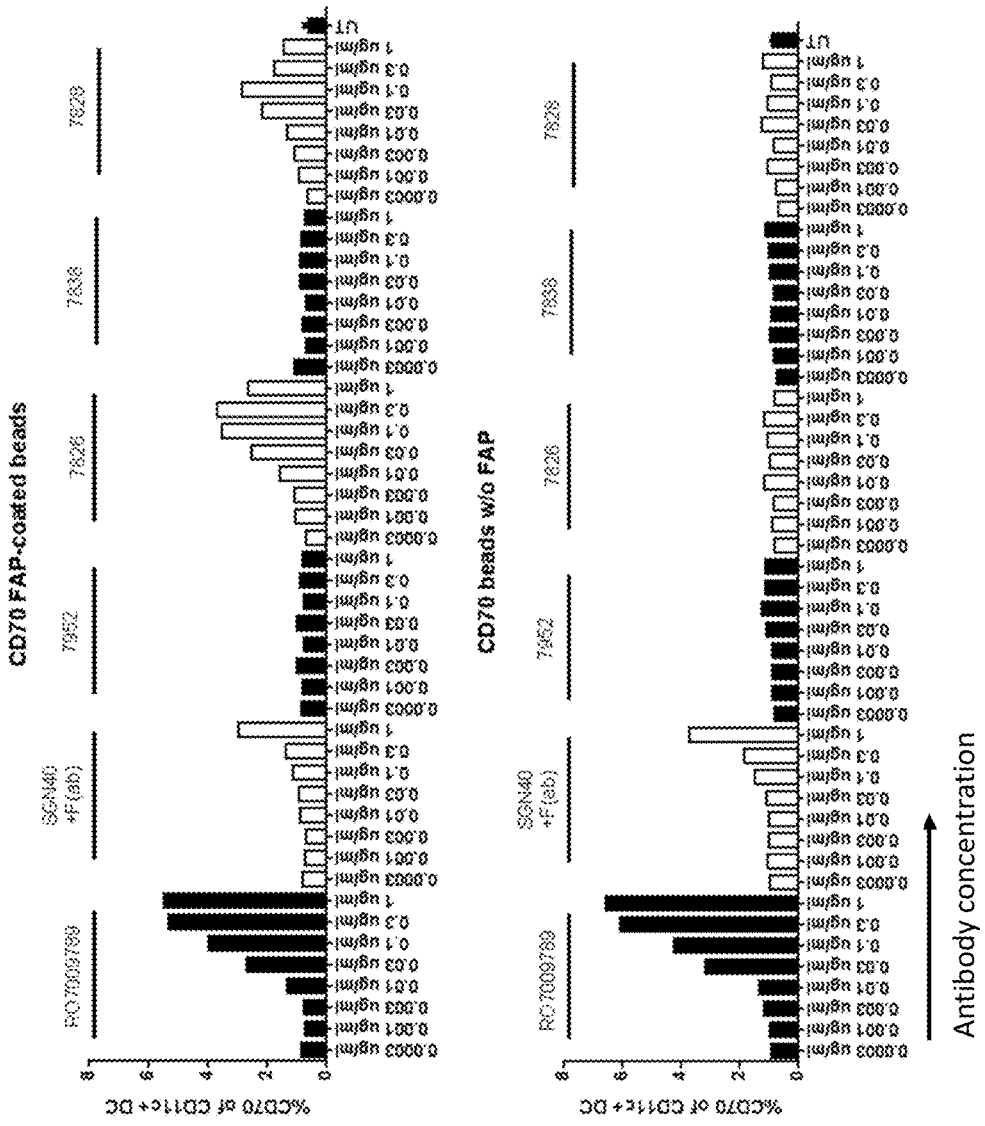

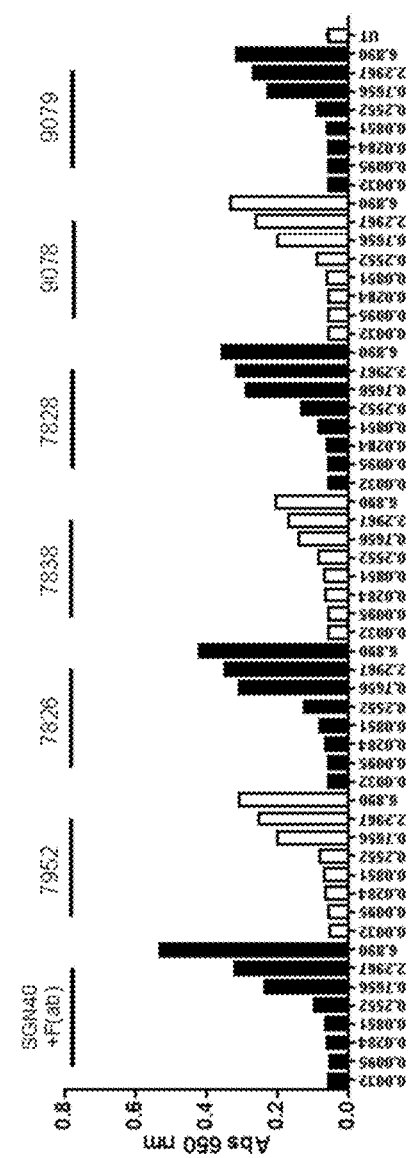
FIG. 8A
FIG. 8B

7838: huCD40 4+2 DP47
7828: huCD40 4+2 FAP
7931: muCD40 4+2 FAP
UT: untreated

7838: huCD40 4+2 DP47
7828: huCD40 4+2 FAP
7931: muCD40 4+2 FAP
UT: untreated

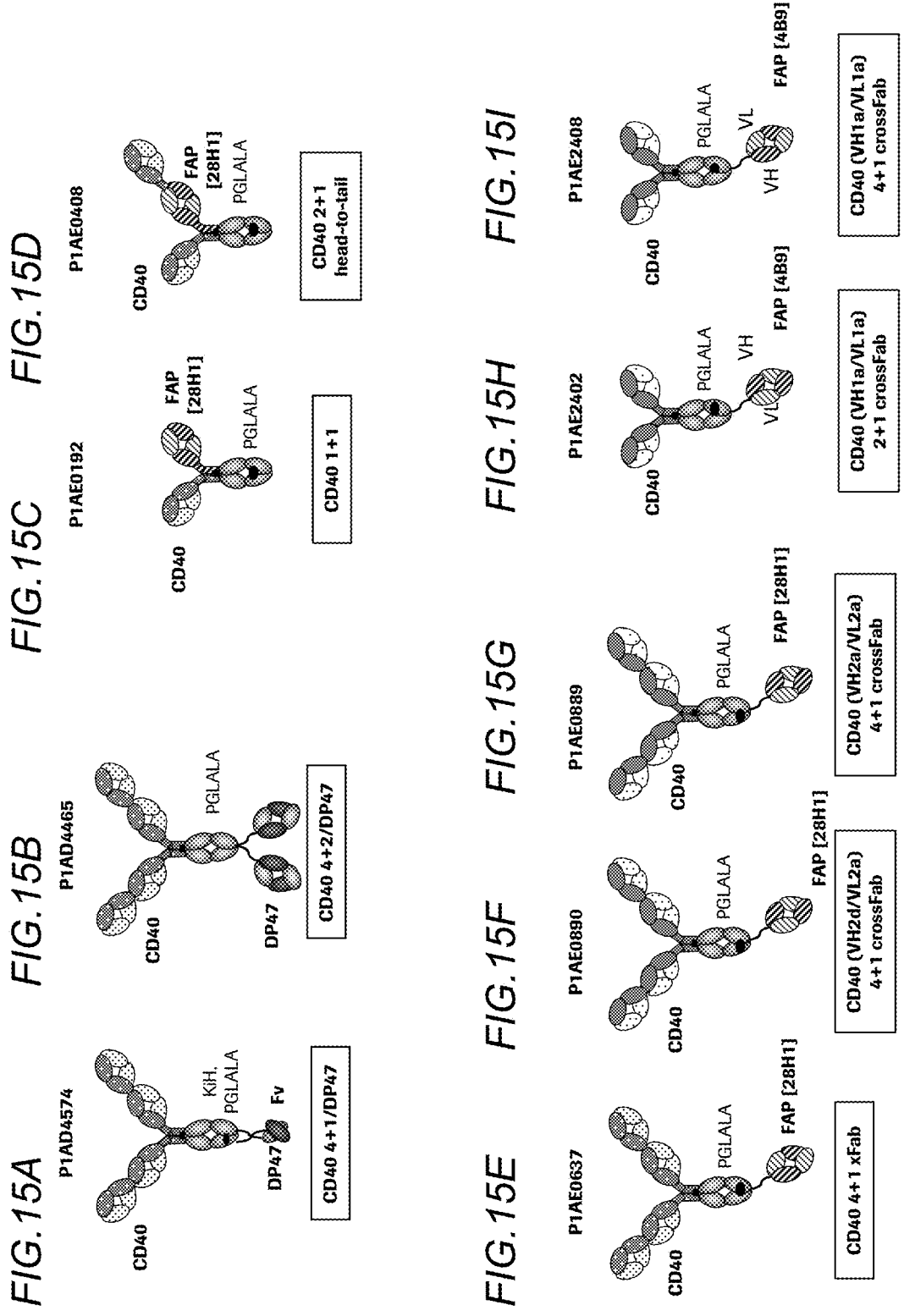

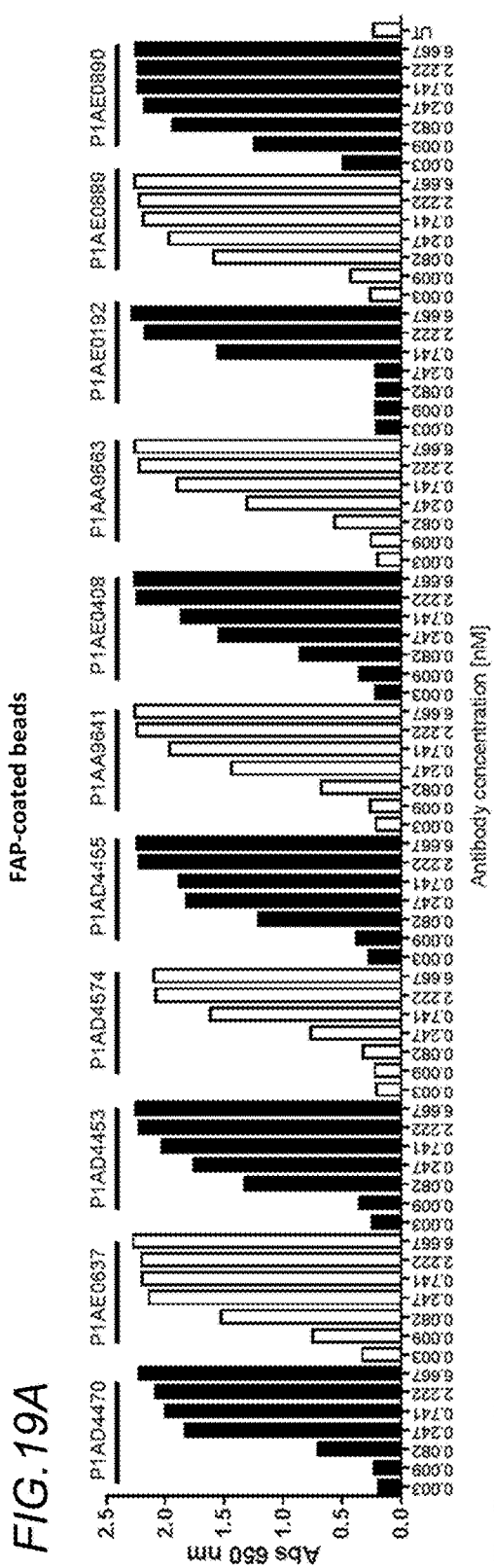
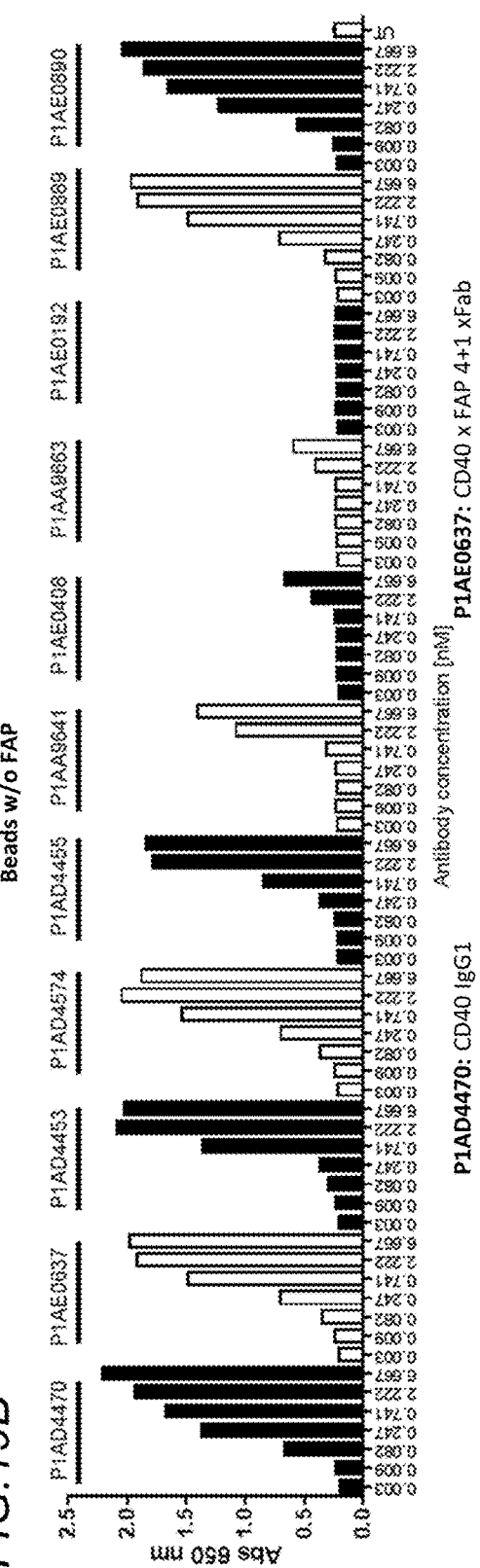
FIG. 19A
FIG. 19B

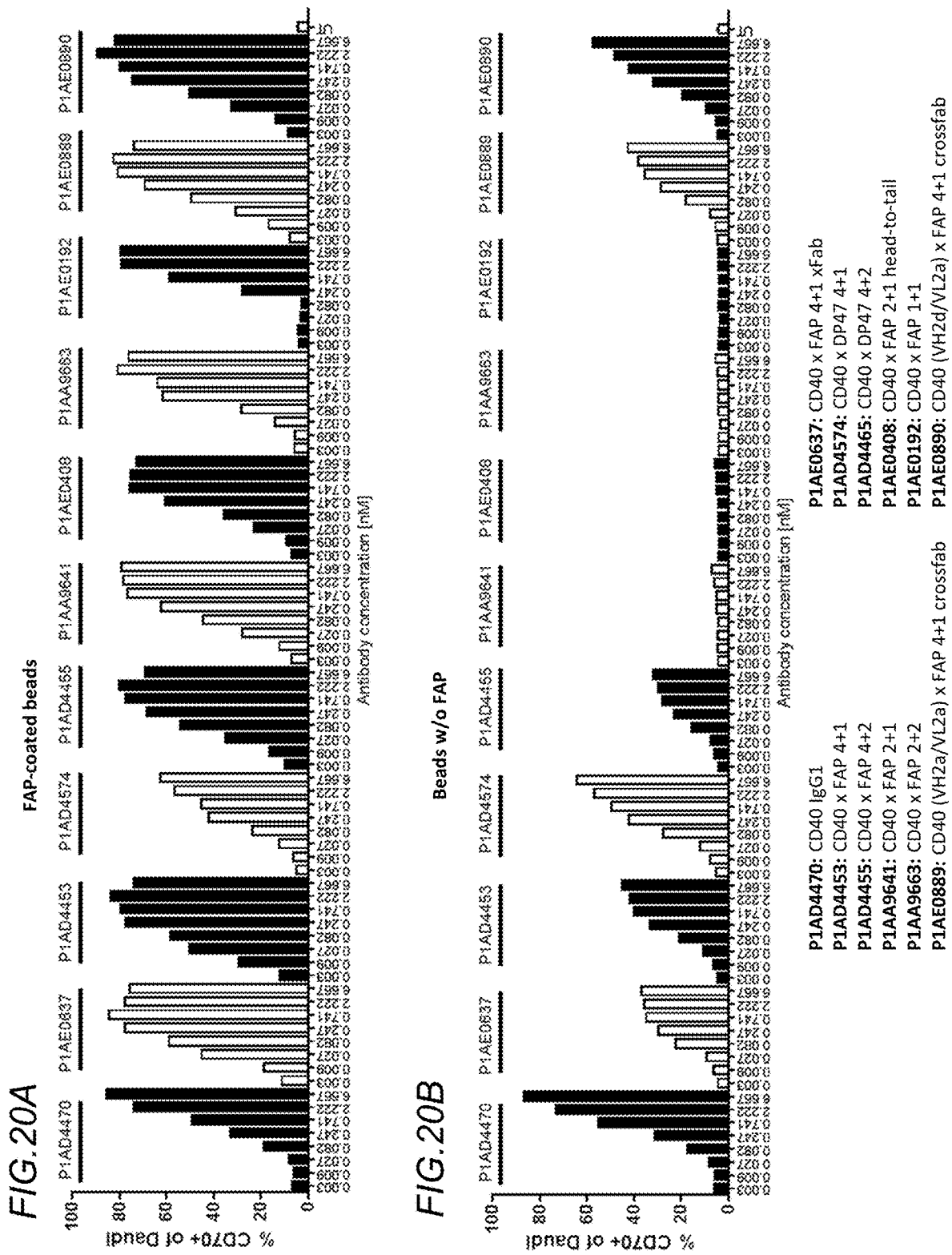

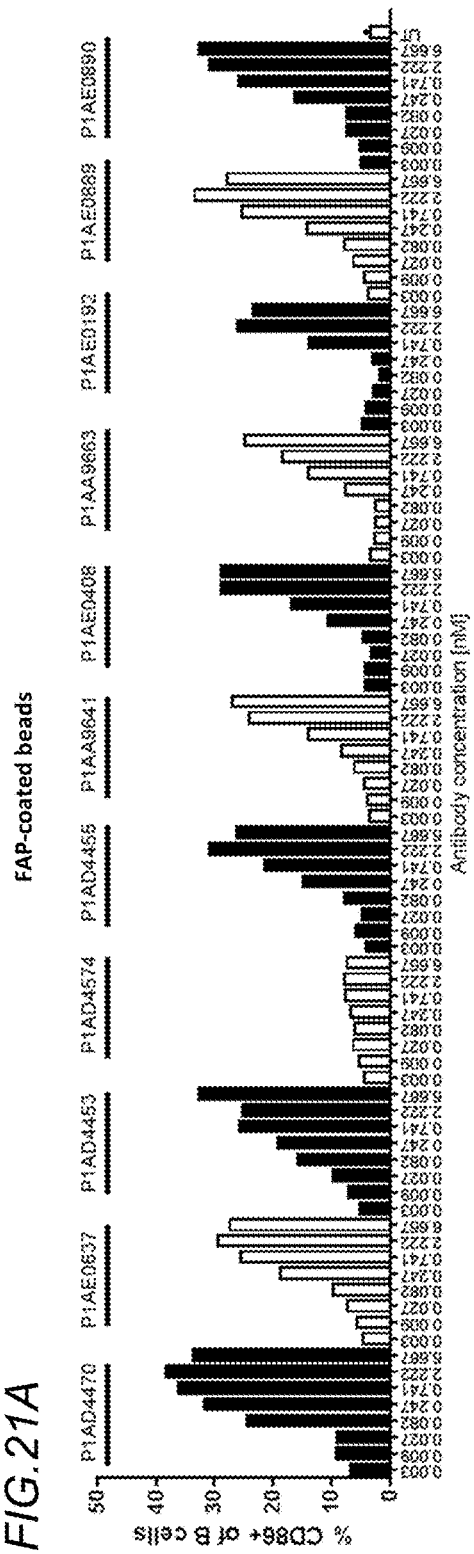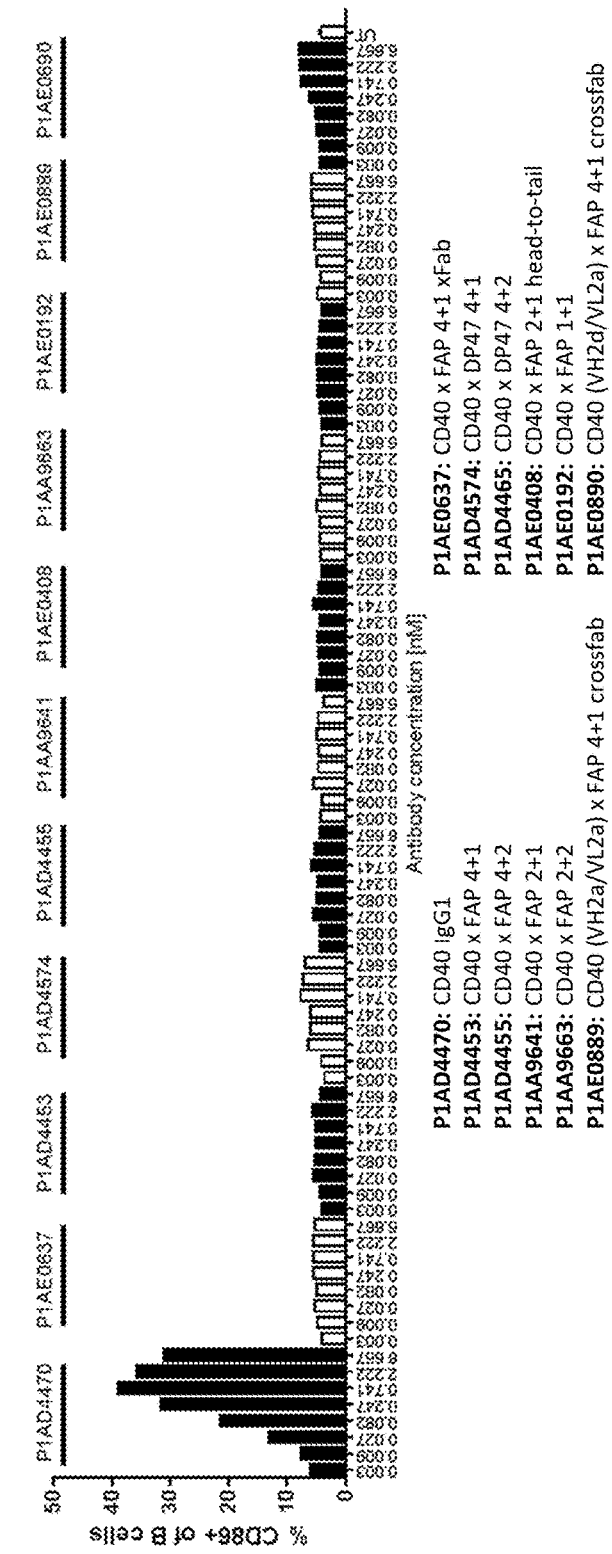
FIG.21A / FIG.21B

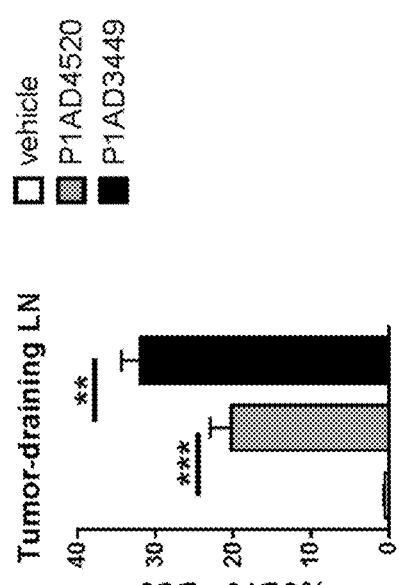
FIG. 24A
FIG. 24B
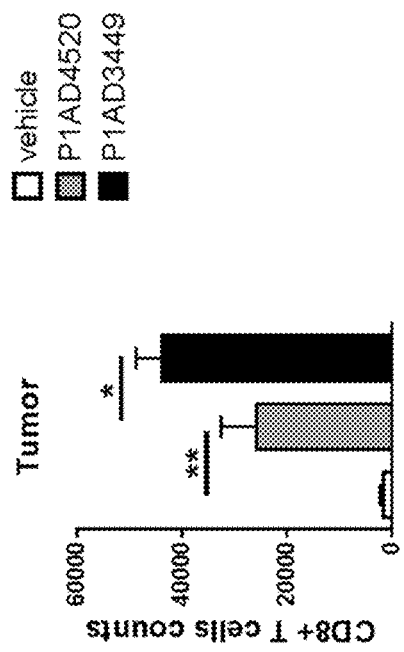
FIG. 24C
FIG. 24D
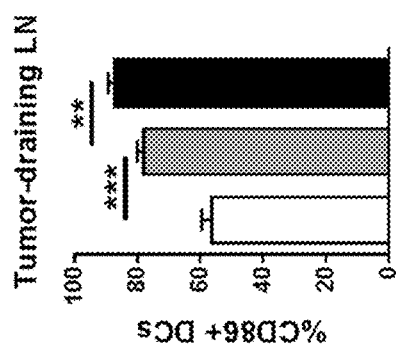
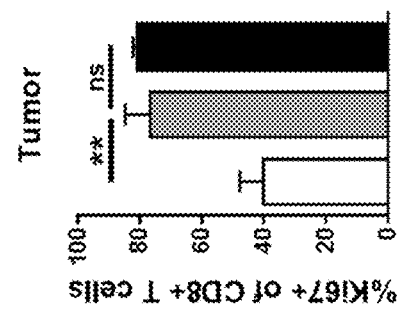

BISPECIFIC ANTIGEN BINDING MOLECULES CAPABLE OF SPECIFIC BINDING TO CD40 AND TO FAP

CROSS-REFERENCE TO RELATED APPLICATIONS

This application is a Continuation of U.S. application Ser. No. 15/943,821, filed Apr. 3, 2018, which claims benefit of priority to European Patent Application No. 17164725.8 filed Apr. 4, 2017 and European Patent Application No. 18158751.0, filed Feb. 27, 2018. The contents of each of the foregoing applications are incorporated herein by reference in their entireties.

SEQUENCE LISTING

This application contains a Sequence Listing which has been submitted electronically in ASCII format and is hereby incorporated by reference in its entirety. Said ASCII copy, created on Feb. 12, 2021, is named P34214-US-1_SeqListing.txt and is 635,571 bytes in size.

Entry of the amendments to the specification is respectfully requested.

FIELD OF THE INVENTION

The invention relates to novel bispecific antigen binding molecules, comprising (a) at least one antigen binding domain capable of specific binding to CD40, and (b) at least one antigen binding domain capable of specific binding to a target cell antigen. In particular, these bispecific antigen binding molecules further comprise (c) a Fc region composed of a first and a second subunit capable of stable association. The invention further relates to methods of producing these molecules and to methods of using the same.

BACKGROUND

Multiple molecular signals are required during the generation of a potent adaptive immune response. Signal one involves the binding of a T-cell antigen receptor (TCR) to its cognate antigen presented on the surface of antigen-presenting cells (APCs), Signal two consists of the engagement of costimulatory receptors with their respective ligands between T cells and APCs. One of the best studied and most important costimulatory effectors is the tumor necrosis factor receptor (TNFR) family member CD40 and its ligand CD40L (Elgueta R. et al., *Immunol Rev.* 2009: 229 (1): 152-72), Several members of the TNFR family including CD40 function after initial T cell activation to sustain APC and T cell responses and thus have pivotal roles in the organization and function of the immune system (Watts T. H. (2005) Annu. Rev. Immunol. 23, 23-68). The combination of different costimulatory TNFR family members allows a sequential and transient regulation of APC and T cell activation and survival resulting in increased immune responses while maintaining tight control of APC and T cell function. Depending on the disease condition, stimulation via costimulatory TNF family members can exacerbate or ameliorate diseases. Activation or blockade of TNFR family costimulators shows promise for several therapeutic applications in multiple fields including cancer, infectious disease, transplantation, and autoimmunity.

Among several costimulatory molecules, the TNFR family member CD40 plays a key role in triggering immune responses by inducing maturation, survival, antigen presentation, cytokine production, and expression of costimulatory molecules of APCs, which then drive antigen-specific T cell responses and NK cell activation by proinflammatory cytokines. CD40 regulates immune responses against infections, tumors and self-antigens and its expression has been demonstrated on the surface of APCs such as B cells, dendritic cells (DCs), monocytes, and macrophages as well as platelets, and cells of non-hematopoietic origin such as myofibroblasts, fibroblasts, epithelial, and endothelial cells (Elgueta R. et al., *Immunol Rev.* 2009: 229 (1): 152-72). The CD40 ligand CD40L is expressed on activated $CD4^+$ helper T cells, platelets, monocytic cells, natural killer cell, mast cells, and basophils (Carbone E, et, al., *J Exp Med.* 1997: 185 (12): 2053-2060, or Elgueta R. et al., *Immunol Rev.* 2009: 229 (1): 152-72). Expression of CD40 and CD40L is strongly upregulated in response to various immune stimulatory signals and CD40-CD40L interaction between APCs and $CD4^+$ T cells contributes to increased APC activation and antigen-specific $CD8^+$ T cell responses (Bevan M. J., *Nat Rev Immunol.* 2014; 4 (8): 595-602), Similar immune stimulatory results were observed by using CD40 agonistic antibodies (Vonderheide R H and Glennie M J., *Clin Cancer Res.* 2013: 19 (5): 1035-43).

Engagement of the type I transmembrane receptor CD40 by its natural ligand CD40L, a type II transmembrane protein or by agonistic antibodies promotes CD40 clustering and induces the recruitment of adapter proteins to the cytoplasmic receptor domain. The recruitment of these adapter proteins known as TNF receptor-associated factors (TRAFs) leads to synergistic activation of mitogen-activated protein kinases (MAPKs), phosphoinositide 3-kinase (PI3K) as well as canonical and non-canonical nuclear factor κB (NFκB) signaling pathways (Elgueta R, et al., *Immunol Rev.* 2009: 229 (1): 152-72). In turn, this results in APC maturation and activation, which then maximizes antigen-specific T cell responses. Recent studies have shown two different modes of action of agonistic CD40 antibodies in harnessing anti-tumor immunity. Beside its indirect mode of action by mediated tumor cell killing through the activation of the adaptive immune system, agonistic CD40 antibodies can induce direct tumor cell killing through inducing apoptosis of CD40-expressing solid tumor cells (Eliopoulos A G. et al., *Mol Cell Biol.* 2000: 20 (15): 5503-15). The direct CD40 antibody-mediated killing of tumor cells can provide a source of tumor antigens that can be processed and presented by APC simultaneously activated by CD40 engagement via anti-CD40 antibodies which then can induce tumor antigen-specific T cells, a postulated mechanism known as endogenous vaccination. Given that CD40 engagement can mount in an efficient anti-cancer immune response, agonistic CD40 antibodies have been used successfully in a variety of preclinical tumor models, both as a single-agent and in combination with chemotherapy (Vonderheide R H and Glennie M J., *Clin Cancer Res.* 2013: 19 (5): 1035-43).

To date, six CD40 mAb are under investigation in clinical trials: Chi Lob 7/4 (CD40) agonistic IgG1 chimeric mAb: Cancer Research U K: Chowdhury F. et al., *Cancer Immunol Res.* 2013:2:229-40). ADC1013 (fully human. CD40 agonistic IgG1 antibody: Alligator Bioscience and Johnson & Johnson: Mangsbo S M. et al., *Clin Cancer Res.* 2015 Mar. 1: 21 (5): 1115-26). APX-005 (fully humanized. CD40 agonistic IgG1 mAb: Apexigen; Bjorck P. et al. *J Immunother Cancer.* 2015: 3 (Suppl 2): P198), SEA-CD40 (CD40 agonistic IgG1 chimeric mAb; Seattle Genetics: Gardai S J. et al. *AACR 106th Annual Meeting* 2015; *April* 18-22, abstract 2472), as well as RO7009789 (fully human. CD40 super agonistic IgG2 mAb) are investigated in clinical phase I studies, and dacetuzumab (CD40 partial agonistic IgG1 chimeric mAb: Seattle Genetics: Khubchandani S. et al., *Curr Opin Investig Drugs.* 2009:10:579-87) is investigated in a clinical phase II study. Eligible patients for these studies have solid tumors, classical Hodgkin lymphoma (HL), diffuse large B-cell lymphoma (DLBCL), or indolent lymphoma (including follicular lymphoma). Diverse activities ranging from Fc-dependent cytotoxicity of CD40' tumor cells via complement mediated cytotoxicity (CMC) or antibody dependent cellular cytotoxicity (ADCC) to APC activation to induce anti-tumor T cell responses as well as macrophage activation to deplete tumor and tumor stroma have been shown for these CD40 agonistic antibodies. So far there is no conclusive explanation for this observed heterogeneity. However, recent studies indicate that this mode of action diversity can be explained, at least in part, by differences of the anti-CD40 antibodies in epitope specificity, isotype or Fc: FcγR interaction. For example, it appears that CD40 agonistic antibodies in vivo require crosslinking CD40, bound by its Fab fragment on the target cell, to a Fcγ receptor, bound by its Fc fragment on a cell other than the target cell as has been described for agonistic antibodies specific to other apoptosis-inducing or immunomodulatory members of the TNFR-superfamily (Dahan R., *Cancer Cell.* 2016 Jun. 13: 29 (6): 820-31; Li F, and Ravetch J. V. *Science.* 2011:333, 1030-1034; Teng M. W, et al., *J. Immunol.* 2009; 183, 1911-1920). The proposed mechanism includes Fcγ receptor mediated clustering of CD40 transmembrane molecules on target cells and subsequent heightened CD40 signaling to achieve potent in vivo efficacy.

The clinical development of agonistic CD40 antibodies has provided promising initial results. In a first clinical trial CP-870.893 has shown clinical efficacy in patients with advanced cancer. Four out of 29 patients with advanced cancer showed partial responses after receiving a single intravenous infusion of CP-870,893 (Vonderheide R H., *J Clin Oncol.* 2007 Mar. 1: 25 (7): 876-83). One out of these four patients treated with 9 subsequent doses of CP-870.893 over one and a half years remained in complete remission for more than 5 years. However, the most common side effects of CP-870.893 are cytokine release syndromes and thromboembolic events, so that with the dose schedules and routes of administration used the combined data of the phase 1 clinical studies with more than 140 patients only indicates a limited clinical efficacy and a local administration of the antibody was suggested (Vonderheide R H. Glennie M. *Clin Cancer Res.* 2013, 19 (5). 1035-1043). The lack of single agent responses occur in part due to severe on target/off tumor effects caused by broad CD40 expression, which results in dose limiting toxicity (e.g. cytokine release syndrome). The development of an agonistic CD40 antibody that specifically activates APCs when CD40 is cross-linked by a tumor-specific target could reduce side effects and decrease dose limitations, offering new therapeutic options with the potential to generate an efficient long lasting anti-cancer immunity.

The available pre-clinical and clinical data clearly demonstrate that there is a high clinical need for effective agonists of CD40 that are able to induce and enhance effective endogenous immune responses to cancer. However, almost never are the effects limited to a single type of cells or acting via a single mechanism and studies designed to elucidate inter- and intracellular signaling mechanisms have revealed increasing levels of complexity. Known CD40 antibodies can only be administered in relatively low doses due to dose-limiting toxicities such as cytokine release syndrome and thrombocyte/endothelial cell activation, resulting in an insufficient activation of the pathway on target APCs and a narrow therapeutic index. Thus, there is a need of "targeted" agonists that preferably act on a single type of cells.

The invention relates to new bispecific antigen binding molecules capable of specific binding to CD40 and a target cell antigen. The antigen binding molecules of the invention combine a moiety capable of preferred binding to tumor-specific or tumor-associated targets with a moiety capable of agonistic binding to CD40, wherein the activation of APCs through CD40 is provided by cross-linking through the target cell antigen, for example FAP expressed on tumor stroma cells and potentially also through FAP intermediately expressed in secondary lymphoid tissues. The FAP-dependent cross-linking of the bispecific antigen binding molecules confines the activation of CD40-expressing cells to the tumor tissue and potentially also to secondary lymphoid tissues such as tumor-draining lymph nodes. In contrast to bispecific antigen binding molecules capable of specific binding to CD40 and to immune checkpoint receptors on activated T cells, such as CTLA-4 or PD-1, targeting to a tumor target such as FAP enables CD40-mediated APC activation mainly in the tumor stroma and tumor-draining lymph nodes where fibroblasts express increased levels of FAP compared to other tissues. The antigen binding molecules of this invention may thus be able to trigger the CD40 receptor not only effectively, but also very selectively at the desired site while overcoming the need for FcγR cross-linking thereby reducing side effects.

SUMMARY OF THE INVENTION

The present invention relates to bispecific antigen binding molecules combining at least one moiety (antigen binding domain) capable of specific binding to the costimulatory TNF receptor family member CD40, with at least one antigen binding side targeting a target cell antigen. These bispecific antigen binding molecules are advantageous as they will preferably activate costimulatory CD40 receptors at the site where the target cell antigen is expressed, due to their binding capability towards a target cell antigen.

In one aspect, the invention provides a bispecific antigen binding molecule, comprising
  (a) at least one antigen binding domain capable of specific binding to CD40, and
  (b) at least one antigen binding domain capable of specific binding to a target cell antigen.

In a particular aspect, the bispecific antigen binding molecule comprises (a) at least one antigen binding domain capable of specific binding to CD40. (b) at least one antigen binding domain capable of specific binding to a target cell antigen, and (c) a Fc domain composed of a first and a second subunit capable of stable association. More particularly, the Fc domain composed of a first and a second subunit capable of stable association comprises mutations that reduce effector function.

In one aspect, the antigen binding domain capable of specific binding to CD40 binds to a polypeptide comprising, or consisting of, the amino acid sequence of SEQ ID NO: 1.

In a further aspect, provided is a bispecific antigen binding molecule, wherein the antigen binding domain capable of specific binding to a target cell antigen is an antigen binding domain capable of specific binding to Fibroblast Activation Protein (FAP). In particular, the antigen binding domain capable of specific binding to FAP binds to a polypeptide comprising, or consisting of, the amino acid sequence of SEQ ID NO:2. Thus, in one aspect, the invention provides a bispecific antigen binding molecule, comprising (a) at least one antigen binding domain capable of specific binding to CD40, and (b) at least one antigen binding domain capable of specific binding to FAP.

In one aspect, the invention provides a bispecific antigen binding molecule, wherein the antigen binding domain capable of specific binding to FAP comprises
  (a) a heavy chain variable region ($V_H$FAP) comprising (i) CDR-H1 comprising the amino acid sequence of SEQ ID NO:3, (ii) CDR-H2 comprising the amino acid sequence of SEQ ID NO: 4, and (iii) CDR-H3 comprising the amino acid sequence of SEQ ID NO:5, and a light chain variable region ($V_L$FAP) comprising (iv) CDR-L1 comprising the amino acid sequence of SEQ ID NO: 6, (v) CDR-L2 comprising the amino acid sequence of SEQ ID NO:7, and (vi) CDR-L3 comprising the amino acid sequence of SEQ ID NO:8, or
  (b) a heavy chain variable region ($V_H$FAP) comprising (i) CDR-H1 comprising the amino acid sequence of SEQ ID NO:11, (ii) CDR-H2 comprising the amino acid sequence of SEQ ID NO: 12, and (iii) CDR-H3 comprising the amino acid sequence of SEQ ID NO: 13, and a light chain variable region ($V_L$FAP) comprising (iv) CDR-L1 comprising the amino acid sequence of SEQ ID NO: 14, (v) CDR-L2 comprising the amino acid sequence of SEQ ID NO: 15, and (vi) CDR-L3 comprising the amino acid sequence of SEQ ID NO: 16.

In a further aspect, provided is a bispecific antigen binding molecule as defined herein before, wherein the antigen binding domain capable of specific binding to FAP comprises
  (a) a heavy chain variable region ($V_H$FAP) comprising an amino acid sequence that is at least about 95%, 96%, 97%, 98%, 99% or 100% identical to the amino acid sequence of SEQ ID NO: 9, and a light chain variable region ($V_L$FAP) comprising an amino acid sequence that is at least about 95%, 96%, 97%, 98%, 99% or 100% identical to the amino acid sequence of SEQ ID NO: 10, or
  (b) a heavy chain variable region ($V_H$FAP) comprising an amino acid sequence that is at least about 95%, 96%, 97%, 98%, 99% or 100% identical to the amino acid sequence of SEQ ID NO: 17, and a light chain variable region ($V_L$FAP) comprising an amino acid sequence that is at least about 95%, 96%, 97%, 98%, 99% or 100% identical to the amino acid sequence of SEQ ID NO: 18.

In particular, provided is a bispecific antigen binding molecule as defined herein before, wherein the antigen binding domain capable of specific binding to FAP comprises (a) a heavy chain variable region ($V_H$FAP) comprising an amino acid sequence of SEQ ID NO:9, and a light chain variable region ($V_L$FAP) comprising an amino acid sequence of SEQ ID NO:10, or (b) a heavy chain variable region ($V_H$FAP) comprising an amino acid sequence of SEQ ID NO: 17, and a light chain variable region ($V_L$FAP) comprising an amino acid sequence of SEQ ID NO: 18.

In a further aspect, provided is a bispecific antigen binding molecule, wherein the antigen binding domain capable of specific binding to CD40 comprises a heavy chain variable region ($V_H$CD40) comprising (i) CDR-H1 comprising the amino acid sequence of SEQ ID NO: 19, (ii) CDR-H2 comprising the amino acid sequence of SEQ ID NO:20, and (iii) CDR-H3 comprising the amino acid sequence of SEQ ID NO:21, and a light chain variable region ($V_L$CD40) comprising (iv) CDR-L1 comprising the amino acid sequence of SEQ ID NO:22, (v) CDR-L2 comprising the amino acid sequence of SEQ ID NO:23, and (vi) CDR-L3 comprising the amino acid sequence of SEQ ID NO:24.

In another aspect, provided is a bispecific antigen binding molecule, wherein the antigen binding domain capable of specific binding to CD40 binds to mouse CD40 and comprises a heavy chain variable region ($V_H$CD40) comprising (i) CDR-H1 comprising the amino acid sequence of SEQ ID NO:27, (ii) CDR-H2 comprising the amino acid sequence of SEQ ID NO: 28, and (iii) CDR-H3 comprising the amino acid sequence of SEQ ID NO:29, and a light chain variable region ($V_L$CD40) comprising (iv) CDR-L1 comprising the amino acid sequence of SEQ ID NO:30, (v) CDR-L2 comprising the amino acid sequence of SEQ ID NO:31, and (vi) CDR-L3 comprising the amino acid sequence of SEQ ID NO:32.

Furthermore, provided is a bispecific antigen binding molecule, wherein the antigen binding domain capable of specific binding to CD40 comprises (a) a VH comprising the amino acid sequence of SEQ ID NO:25 and a VL comprising the amino acid sequence of SEQ ID NO: 26, or (b) a VH comprising the amino acid sequence of SEQ ID NO:33 and a VL comprising the amino acid sequence of SEQ ID NO:34. In a particular aspect, the invention provides a bispecific antigen binding molecule, wherein each of the antigen binding domains capable of specific binding to CD40 comprises a VH comprising the amino acid sequence of SEQ ID NO: 25 and a VL comprising the amino acid sequence of SEQ ID NO:26.

In a further aspect, provided is a bispecific antigen binding molecule, wherein the antigen binding domain capable of specific binding to CD40 comprises a heavy chain variable region ($V_H$CD40) comprising
  (i) CDR-H1 comprising the amino acid sequence selected from the group consisting of SEQ ID NO: 19 and SEQ ID NO:35,
  (ii) CDR-H2 comprising the amino acid sequence selected from the group consisting of SEQ ID NO:20, SEQ ID NO:36, SEQ ID NO:37, SEQ ID NO: 38, SEQ ID NO: 39, SEQ ID NO: 40, SEQ ID NO:41, SEQ ID NO: 42, SEQ ID NO:43 and SEQ ID NO:44, and
  (iii) CDR-H3 comprising the amino acid sequence of SEQ ID NO:21, and a light chain variable region ($V_L$CD40) comprising
  (iv) CDR-L1 comprising the amino acid sequence of SEQ ID NO:22,
  (v) CDR-L2 comprising the amino acid sequence of SEQ ID NO:23, and
  (vi) CDR-L3 comprising the amino acid sequence of SEQ ID NO:24.

In yet another aspect, provided is a bispecific antigen binding molecule, wherein the antigen binding domain capable of specific binding to CD40 comprises a heavy chain variable region ($V_H$CD40) comprising
  (i) CDR-H1 comprising the amino acid sequence selected from the group consisting of SEQ ID NO: 19 and SEQ ID NO:261,
  (ii) CDR-H2 comprising the amino acid sequence selected from the group consisting of SEQ ID NO:20, SEQ ID NO:262 and SEQ ID NO:263, and
  (iii) CDR-H3 comprising the amino acid sequence of SEQ ID NO:21, and a light chain variable region ($V_L$CD40) comprising
  (iv) CDR-L1 comprising the amino acid sequence of SEQ ID NO:22, SEQ ID NO:264 and SEQ ID NO:265,
  (v) CDR-L2 comprising the amino acid sequence of SEQ ID NO:23, and (vi) CDR-L3 comprising the amino acid sequence of SEQ ID NO:24.

Furthermore, provided is a bispecific antigen binding molecule, wherein the antigen binding domain capable of specific binding to CD40 comprises
  (i) a heavy chain variable region ($V_HCD40$) comprising an amino acid sequence selected from the group consisting of SEQ ID NO: 171, SEQ ID NO: 172, SEQ ID NO: 173 and SEQ ID NO: 174, and
  (ii) a light chain variable region ($V_LCD40$) comprising the amino acid sequence selected from the group consisting of SEQ ID NO: 175, SEQ ID NO: 176, SEQ ID NO: 177, and SEQ ID NO: 178.

In particular, a bispecific antigen binding molecule is provided, wherein the antigen binding domain capable of specific binding to CD40 comprises
  (a) a VH comprising the amino acid sequence of SEQ ID NO: 171 and a VL comprising the amino acid sequence of SEQ ID NO:175, or
  (b) a VH comprising the amino acid sequence of SEQ ID NO:173 and a VL comprising the amino acid sequence of SEQ ID NO: 177, or
  (c) a VH comprising the amino acid sequence of SEQ ID NO: 174 and a VL comprising the amino acid sequence of SEQ ID NO: 178, or
  (d) a VH comprising the amino acid sequence of SEQ ID NO:171 and a VL comprising the amino acid sequence of SEQ ID NO:177, or
  (e) a VH comprising the amino acid sequence of SEQ ID NO: 171 and a VL comprising the amino acid sequence of SEQ ID NO: 178, or
  (f) a VH comprising the amino acid sequence of SEQ ID NO:173 and a VL comprising the amino acid sequence of SEQ ID NO: 175, or
  (g) a VH comprising the amino acid sequence of SEQ ID NO: 173 and a VL comprising the amino acid sequence of SEQ ID NO: 178, or
  (h) a VH comprising the amino acid sequence of SEQ ID NO: 174 and a VL comprising the amino acid sequence of SEQ ID NO:175, or
  (i) a VH comprising the amino acid sequence of SEQ ID NO: 174 and a VL comprising the amino acid sequence of SEQ ID NO:177, or
  (j) a VH comprising the amino acid sequence of SEQ ID NO: 171 and a VL comprising the amino acid sequence of SEQ ID NO: 176, or
  (k) a VH comprising the amino acid sequence of SEQ ID NO:172 and a VL comprising the amino acid sequence of SEQ ID NO: 175, or
  (l) a VH comprising the amino acid sequence of SEQ ID NO: 172 and a VL comprising the amino acid sequence of SEQ ID NO: 176, or
  (m) a VH comprising the amino acid sequence of SEQ ID NO: 172 and a VL comprising the amino acid sequence of SEQ ID NO: 177, or
  (n) a VH comprising the amino acid sequence of SEQ ID NO: 172 and a VL comprising the amino acid sequence of SEQ ID NO:178, or
  (o) a VH comprising the amino acid sequence of SEQ ID NO: 173 and a VL comprising the amino acid sequence of SEQ ID NO: 176, or
  (p) a VH comprising the amino acid sequence of SEQ ID NO:174 and a VL comprising the amino acid sequence of SEQ ID NO:176.

More particularly, provided is a bispecific antigen binding, wherein the antigen binding domain capable of specific binding to CD40 comprises a VH comprising the amino acid sequence of SEQ ID NO: 171 and a VL comprising the amino acid sequence of SEQ ID NO: 175.

In a further aspect, provided is a bispecific antigen binding molecule of any one of claims 1 to 7, wherein the antigen binding domain capable of specific binding to CD40 comprises
  (i) a heavy chain variable region ($V_HCD40$) comprising an amino acid sequence selected from the group consisting of SEQ ID NO: 179, SEQ ID NO: 180, SEQ ID NO: 181, SEQ ID NO: 182, SEQ ID NO: 183 and SEQ ID NO: 184, and
  (ii) a light chain variable region ($V_LCD40$) comprising the amino acid sequence selected from the group consisting of SEQ ID NO: 185, SEQ ID NO: 186, SEQ ID NO: 187, and SEQ ID NO: 188.

In particular, a bispecific antigen binding molecule is provided, wherein the antigen binding domain capable of specific binding to CD40 comprises
  (a) a VH comprising the amino acid sequence of SEQ ID NO: 179 and a VL comprising the amino acid sequence of SEQ ID NO: 185, or
  (b) a VH comprising the amino acid sequence of SEQ ID NO:180 and a VL comprising the amino acid sequence of SEQ ID NO:185, or
  (c) a VH comprising the amino acid sequence of SEQ ID NO: 181 and a VL comprising the amino acid sequence of SEQ ID NO: 185, or
  (d) a VH comprising the amino acid sequence of SEQ ID NO: 182 and a VL comprising the amino acid sequence of SEQ ID NO: 185, or
  (e) a VH comprising the amino acid sequence of SEQ ID NO: 179 and a VL comprising the amino acid sequence of SEQ ID NO:186, or
  (f) a VH comprising the amino acid sequence of SEQ ID NO: 180 and a VL comprising the amino acid sequence of SEQ ID NO:186, or
  (g) a VH comprising the amino acid sequence of SEQ ID NO: 181 and a VL comprising the amino acid sequence of SEQ ID NO: 186, or
  (h) a VH comprising the amino acid sequence of SEQ ID NO: 182 and a VL comprising the amino acid sequence of SEQ ID NO: 186, or
  (i) a VH comprising the amino acid sequence of SEQ ID NO: 183 and a VL comprising the amino acid sequence of SEQ ID NO: 187, or
  (j) a VH comprising the amino acid sequence of SEQ ID NO: 183 and a VL comprising the amino acid sequence of SEQ ID NO: 188, or
  (k) a VH comprising the amino acid sequence of SEQ ID NO: 184 and a VL comprising the amino acid sequence of SEQ ID NO:187, or
  (l) a VH comprising the amino acid sequence of SEQ ID NO: 184 and a VL comprising the amino acid sequence of SEQ ID NO: 188.

More particularly, provided is a bispecific antigen binding, wherein the antigen binding domain capable of specific binding to CD40 comprises a VH comprising the amino acid sequence of SEQ ID NO: 179 and a VL comprising the amino acid sequence of SEQ ID NO: 185 or wherein the antigen binding domain capable of specific binding to CD40 comprises a VH comprising the amino acid sequence of SEQ ID NO: 182 and a VL comprising the amino acid sequence of SEQ ID NO: 185.

In another aspect, provided is a bispecific antigen binding molecule, wherein the antigen binding domain capable of specific binding to CD40 comprises (i) a heavy chain variable region ($V_H$CD40) comprising an amino acid sequence selected from the group consisting of SEQ ID NO:45, SEQ ID NO:46, SEQ ID NO:47, SEQ ID NO:48. SEQ ID NO:49, SEQ ID NO:50, SEQ ID NO:51, SEQ ID NO:52, SEQ ID NO:53, SEQ ID NO: 54 and SEQ ID NO:55, and (ii) a light chain variable region ($V_L$CD40) comprising the amino acid sequence selected from the group consisting of SEQ ID NO:56, SEQ ID NO:57, SEQ ID NO:58, SEQ ID NO:59. SEQ ID NO:60, SEQ ID NO: 61, SEQ ID NO: 62, SEQ ID NO: 63 and SEQ ID NO:64.

Particularly, a bispecific antigen binding molecule is provided, wherein each of the moieties capable of specific binding to CD40 comprises a VH comprising the amino acid sequence of SEQ ID NO:47 and a VL comprising the amino acid sequence of SEQ ID NO:57.

Furthermore, provided is a bispecific antigen binding molecule comprising (i) at least one antigen binding domain capable of specific binding to CD40, comprising a heavy chain variable region ($V_H$CD40) comprising an amino acid sequence selected from the group consisting of SEQ ID NO: 171, SEQ ID NO: 172, SEQ ID NO: 173, SEQ ID NO: 174, SEQ ID NO: 179, SEQ ID NO:180, SEQ ID NO: 181, SEQ ID NO: 182, SEQ ID NO: 183 and SEQ ID NO: 184, and a light chain variable region ($V_L$CD40) comprising an amino acid sequence selected from the group consisting of SEQ ID NO:175, SEQ ID NO: 176, SEQ ID NO: 177, SEQ ID NO: 178, SEQ ID NO:185, SEQ ID NO: 186, SEQ ID NO: 187 and SEQ ID NO: 188, and (ii) at least one antigen binding domain capable of specific binding to FAP, comprising a heavy chain variable region ($V_H$FAP) comprising an amino acid sequence of SEQ ID NO:9 and a light chain variable region ($V_L$FAP) comprising an amino acid sequence of SEQ ID NO: 10, or a heavy chain variable region ($V_H$FAP) comprising an amino acid sequence of SEQ ID NO: 17 and a light chain variable region ($V_L$FAP) comprising an amino acid sequence of SEQ ID NO:18.

In another aspect, provided is a bispecific antigen binding molecule comprising (i) at least one antigen binding domain capable of specific binding to CD40, comprising a heavy chain variable region ($V_H$CD40) comprising an amino acid sequence selected from the group consisting of SEQ ID NO:25, SEQ ID NO:45, SEQ ID NO:46, SEQ ID NO:47, SEQ ID NO: 48, SEQ ID NO:49, SEQ ID NO:50, SEQ ID NO:51, SEQ ID NO:52, SEQ ID NO:53, SEQ ID NO: 54 and SEQ ID NO:55, and a light chain variable region ($V_L$CD40) comprising an amino acid sequence selected from the group consisting of SEQ ID NO:26, SEQ ID NO:56, SEQ ID NO: 57, SEQ ID NO:58, SEQ ID NO:59, SEQ ID NO:60, SEQ ID NO:61, SEQ ID NO:62, SEQ ID NO: 63 and SEQ ID NO:64, and (ii) at least one antigen binding domain capable of specific binding to FAP, comprising a heavy chain variable region ($V_H$FAP) comprising an amino acid sequence of SEQ ID NO:9 and a light chain variable region ($V_L$FAP) comprising an amino acid sequence of SEQ ID NO: 10, or a heavy chain variable region ($V_H$FAP) comprising an amino acid sequence of SEQ ID NO: 17 and a light chain variable region ($V_L$FAP) comprising an amino acid sequence of SEQ ID NO:18.

In one aspect, the bispecific antigen binding molecule is a humanized or a chimeric antibody. In a further aspect, the bispecific antigen binding molecule comprises an IgG Fc region, particularly an IgG1 Fc region or an IgG4 Fc region. In particular, the Fc region comprises one or more amino acid substitution that reduces the binding affinity of the antibody to an Fc receptor and/or effector function. In a particular aspect, provided is a bispecific antigen binding molecule, wherein the Fc region is (i) of human IgG1 subclass with the amino acid mutations L234A. L235A and P329G (numbering according to Kabat EU index), or (ii) of mouse IgG1 subclass with the amino acid mutations D265A and P329G (numbering according to Kabat EU index). Particularly, the Fc region is of human IgG1 subclass with the amino acid mutations L234A. L235A and P329G (numbering according to Kabat EU index).

In another aspect, provided is a bispecific antigen binding molecule as defined herein before, wherein the first subunit of the Fc region comprises knobs and the second subunit of the Fc region comprises holes according to the knobs into holes method. In particular, provided is a bispecific antigen binding molecule, wherein (i) the first subunit of the Fc region comprises the amino acid substitutions S354C and T366W (numbering according to Kabat EU index) and the second subunit of the Fc region comprises the amino acid substitutions Y349C. T366S and Y407V (numbering according to Kabat EU index), or (ii) the first subunit of the Fc region comprises the amino acid substitutions K392D and K409D (numbering according to Kabat EU index) and the second subunit of the Fc region comprises the amino acid substitutions E356K and D399K (numbering according to Kabat EU index). More particularly, provided is a bispecific antigen binding molecule, wherein the first subunit of the Fc region comprises the amino acid substitutions S354C and T366W (numbering according to Kabat EU index) and the second subunit of the Fc region comprises the amino acid substitutions Y349C. T366S and Y407V (numbering according to Kabat EU index).

In a further aspect, provided is a bispecific antigen binding molecule, wherein the bispecific antigen binding molecule comprises (a) at least two Fab fragments capable of specific binding to CD40 connected to a Fc region, and (b) at least one antigen binding domain capable of specific binding to FAP connected to the C-terminus of the Fc region.

In another aspect, provided is a bispecific antigen binding molecule, wherein the bispecific antigen binding molecule comprises (a) at least two Fab fragments capable of specific binding to CD40 connected to a Fc region, and (b) one antigen binding domain capable of specific binding to FAP connected to the C-terminus of the Fc region.

In a particular aspect, the antigen binding domain capable of specific binding to FAP connected to the C-terminus of the Fc region is a cross-fab fragment. Thus, provided is a bispecific antigen binding molecule, wherein the bispecific antigen binding molecule comprises (a) at least two Fab fragments capable of specific binding to CD40 connected to a Fc region, and (b) a cross-fab fragment capable of specific binding to FAP connected to the C-terminus of the Fc region.

In one aspect, provided is a bispecific antigen binding molecule comprising (a) two light chains and two heavy chains of an antibody comprising two Fab fragments capable of specific binding to CD40, and a Fc region, and (b) a VH and a VL of an antigen binding domain capable specific binding to FAP, wherein the VH is connected to the C-terminus of one of the two heavy chains of (a), and wherein the VL is connected to the C-terminus of the other of the two heavy chains of (a).

In another aspect, provided is a bispecific antigen binding molecule comprising
(a) two light chains and two heavy chains of an antibody comprising two Fab fragments capable of specific binding to CD40, and a Fc region, and
(b) a cross-fab fragment capable specific binding to FAP, wherein the VH-CL chain is connected to the C-terminus of one of the two heavy chains of (a).

In yet another aspect, provided is a bispecific antigen binding molecule comprising
(a) two light chains and two heavy chains of an antibody comprising two Fab fragments capable of specific binding to CD40, and a Fc region, and
(b) a cross-fab fragment capable specific binding to FAP, wherein the VL-CH1 chain is connected to the C-terminus of one of the two heavy chains of (a).

Furthermore, provided is a bispecific antigen binding molecule comprising
(a) two light chains and two heavy chains of an antibody comprising two Fab fragments capable of specific binding to CD40, and a Fc region, and
(b) two Fab fragments capable of specific binding to FAP, wherein one of the Fab fragments is connected to the C-terminus of one of the two heavy chains of (a), and the other of the Fab fragments is connected to the C-terminus of the other of the two heavy chains of (a).

In another aspect, the invention provides a bispecific antigen binding molecule comprising
(a) two heavy chains, each heavy chain comprising a VH and CH1 domain of a Fab fragment capable of specific binding to CD40 and a Fc region subunit,
(b) two light chains, each light chain comprising a VL and CL domain of a Fab fragment capable of specific binding to CD40, and
(c) a VH and a VL of an antigen binding domain capable of specific binding to FAP, wherein the VH is connected to the C-terminus of one of the two heavy chains of (a), and wherein the VL is connected to the C-terminus of the other of the two heavy chains of (a).

In a further aspect, provided is a bispecific antigen binding molecule comprising
(a) two heavy chains, each heavy chain comprising a VH and CH1 domain of a Fab fragment capable of specific binding to CD40, and a Fc region subunit,
(b) two light chains, each light chain comprising a VL and CL domain of a Fab fragment capable of specific binding to CD40, and
(c) two Fab fragments capable of specific binding to FAP, wherein one of the Fab fragments is connected to the C-terminus of one of the two heavy chains of (a), and the other of the Fab fragments is connected to the C-terminus of the other of the two heavy chains of (a).

In another aspect, provided is a bispecific antigen binding molecule, wherein the bispecific antigen binding molecule comprises
(a) two heavy chains, each heavy chain comprising a VH and CH1 domain of a Fab fragment capable of specific binding to CD40, and a Fc region subunit,
(b) two light chains, each light chain comprising a VL and CL domain of a Fab fragment capable of specific binding to CD40, and
(c) one Fab fragment capable of specific binding to FAP, wherein the Fab fragments is connected to the C-terminus of one of the two heavy chains of (a).

In another aspect, the Fab fragment or the two Fab fragments capable of specific binding to FAP are crossover Fab fragments each comprising a VL-CH1 chain and a VH-CL chain, and wherein the VH-CL chain or the VL-CH1 chain is connected to the C-terminus of one of the two heavy chains of (a).

In one aspect, provided is a bispecific antigen binding molecule, wherein the bispecific antigen binding molecule comprises four Fab fragments capable of specific binding to CD40. In a particular aspect, provided is a bispecific antigen binding molecule, wherein each of the two heavy chains of (a) as defined herein before comprises two VH-CH1 chains of a Fab fragment capable of specific binding to CD40 that are connected to each other, optionally by a peptide linker.

In another aspect, the invention provides a bispecific antigen binding molecule comprising
(a) two heavy chains, each heavy chain comprising two VH-CH1 chains of a Fab fragment capable of specific binding to CD40 that are connected to each other, optionally by a peptide linker, and a Fc region subunit,
(b) four light chains, each light chain comprising a VL and CL domain of a Fab fragment capable of specific binding to CD40, and
(c) a VH and a VL of an antigen binding domain capable of specific binding to FAP, wherein the VH is connected to the C-terminus of one of the two heavy chains of (a), and wherein the VL is connected to the C-terminus of the other of the two heavy chains of (a).

In another aspect, provided is a bispecific antigen binding molecule, wherein the bispecific antigen binding molecule comprises
(a) two heavy chains, each heavy chain comprising two VH-CH1 chains of a Fab fragment capable of specific binding to CD40 that are connected to each other, optionally by a peptide linker, and a Fc region subunit,
(b) four light chains, each light chain comprising a VL and CL domain of a Fab fragment capable of specific binding to CD40, and
(c) one Fab fragment or cross-Fab fragment capable of specific binding to FAP, wherein the Fab or cross-Fab fragment is connected to the C-terminus of one of the two heavy chains of (a).

In another aspect, provided is a bispecific antigen binding molecule comprising
(a) two heavy chains, each heavy chain comprising two VH-CH1 chains of a Fab fragment capable of specific binding to CD40 that are connected to each other, optionally by a peptide linker, and a Fc region subunit,
(b) four light chains, each light chain comprising a VL and CL domain of a Fab fragment capable of specific binding to CD40, and
(c) a cross-fab fragment capable specific binding to FAP, wherein the VH-CL chain of said cross-fab fragment is connected to the C-terminus of one of the two heavy chains of (a).

In yet another aspect, provided is a bispecific antigen binding molecule comprising
(a) two heavy chains, each heavy chain comprising two VH-CH1 chains of a Fab fragment capable of specific binding to CD40 that are connected to each other, optionally by a peptide linker, and a Fc region subunit,
(b) four light chains, each light chain comprising a VL and CL domain of a Fab fragment capable of specific binding to CD40, and
(c) a cross-fab fragment capable specific binding to FAP, wherein the VL-CH1 chain of said cross-fab fragment is connected to the C-terminus of one of the two heavy chains of (a).

In another particular aspect, provided is a bispecific antigen binding molecule, wherein one or more of the Fab fragments capable of specific binding to CD40 comprises a CL domain comprising an arginine (R) at amino acid at position 123 (numbering according to Kabat EU index) and a lysine (K) at amino acid at position 124 (numbering according to Kabat EU index), and a CH1 domain comprising a glutamic acid (E) at amino acid at position 147 (numbering according to Kabat EU index) and a glutamic acid (E) at amino acid at position 213 (numbering according to Kabat EU index).

According to another aspect of the invention, there is provided an isolated polynucleotide encoding a bispecific antigen binding molecule as described herein before. The invention further provides a vector, particularly an expression vector, comprising the isolated polynucleotide of the invention and a host cell comprising the isolated polynucleotide or the expression vector of the invention. In some aspects the host cell is a eukaryotic cell, particularly a mammalian cell.

In another aspect, provided is a method of producing a bispecific antigen binding molecule as described herein before, comprising culturing the host cell as described above under conditions suitable for the expression of the bispecific antigen binding molecule, and isolating the bispecific antigen binding molecule. The invention also encompasses the bispecific antigen binding molecule that specifically binds to CD40 and to FAP produced by the method of the invention.

The invention further provides a pharmaceutical composition comprising a bispecific antigen binding molecule as described herein before and at least one pharmaceutically acceptable excipient.

Also encompassed by the invention is the bispecific antigen binding molecule as described herein before, or the pharmaceutical composition comprising the bispecific antigen binding molecule, for use as a medicament.

In one aspect, provided is a bispecific antigen binding molecule as described herein before or the pharmaceutical composition of the invention, for use
(i) in inducing immune stimulation by CD40 expressing antigen-presenting cells (APCs),
(ii) in stimulating tumor-specific T cell response,
(iii) in causing apoptosis of tumor cells,
(iv) in the treatment of cancer,
(v) in delaying progression of cancer.
(vi) in prolonging the survival of a patient suffering from cancer.
(vii) in the treatment of infections.

In a specific aspect, provided is the bispecific antigen binding molecule as described herein before or the pharmaceutical composition of the invention, for use in the treatment of cancer. In another specific aspect, the invention provides the bispecific antigen binding molecule as described herein before for use in the treatment of cancer, wherein the bispecific antigen binding molecule is administered in combination with a chemotherapeutic agent, radiation and/or other agents for use in cancer immunotherapy. In another aspect, provided is the bispecific antigen binding molecule as described herein before or the pharmaceutical composition of the invention, for use in up-regulating or prolonging cytotoxic T cell activity.

In a further aspect, the invention provides a method of inhibiting the growth of tumor cells in an individual comprising administering to the individual an effective amount of the bispecific antigen binding molecule as described herein before, or the pharmaceutical composition of the invention, to inhibit the growth of the tumor cells. In another aspect, the invention provides a method of treating or delaying cancer in an individual comprising administering to the individual an effective amount of the bispecific antigen binding molecule as described herein before, or the pharmaceutical composition of the invention.

Also provided is the use of the bispecific antigen binding molecule as described herein before for the manufacture of a medicament for the treatment of a disease in an individual in need thereof, in particular for the manufacture of a medicament for the treatment of cancer, as well as a method of treating a disease in an individual, comprising administering to said individual a therapeutically effective amount of a composition comprising the bispecific antigen binding molecule of the invention in a pharmaceutically acceptable form. In a specific aspect, the disease is cancer. In any of the above aspects the individual is a mammal, particularly a human.

BRIEF DESCRIPTION OF THE DRAWINGS

FIG. 1A shows a schematic representation of a bispecific CD40-FAP antibody in the 4+1 format consisting of four CD40 binding Fab domains combined with one FAP binding moiety with VH at the C-terminus of one heavy chain and VL at the C-terminus of the other heavy chain (tetravalent for CD40) and monovalent for FAP). The black point symbolizes knob-into-hole mutations. FIG. 1B shows a schematic representation of a bispecific CD40-FAP antibody in the 4+2 format consisting of four CD40 binding Fab domains combined with two FAP binding Fab domains fused each at the C-terminus of the heavy chains (tetravalent for CD40) and bivalent for FAP). FIG.C shows a schematic representation of a bispecific CD40-FAP antibody in the 2+1 format consisting of two CD40 binding Fab domains combined with one FAP binding moiety with VH at the C-terminus of one heavy chain and VL at the C-terminus of the other heavy chain (bivalent for CD40) and monovalent for FAP). The black point symbolizes knob-into-hole mutations. FIG. 1D shows a schematic representation of a bispecific CD40-FAP antibody in the 2+2 format consisting of two CD40 binding Fab domains combined with two FAP binding Fab domains fused each at the C-terminus of the heavy chains (bivalent for CD40) and bivalent for FAP). FIG. 1F shows a schematic representation of a bispecific CD40-FAP antibody in the 1+1 format consisting of one CD40) binding arm combined with one FAP binding arm (monovalent for CD40) and monovalent for FAP). The black point symbolizes knob-into-hole mutations.

FIG. 3A, FIG. 3B, FIG. 3C, FIG. 3D, FIG. 3E, FIG. 3F, FIG. 3G, FIG. 3H show the in vitro activation of human B cells by mono- or bivalent FAP-targeted anti-CD40) constructs. With NIH/3T3-FAP cells the bispecific antibody monovalent for FAP induced a similar increase of B cell activation marker expression (CD70. CD80. CD83, and CD86) as the bivalent FAP-targeted molecule. Moreover, the B cell activation marker upregulation by FAP-targeted bispecific antigen-binding molecules was comparable to the upregulation induced by the FAP-independent positive control antibodies. In the absence of FAP (NIH/3T3-wt cells) no increase of B cell activation markers could be observed with the bispecific antigen binding molecules, while positive control antibodies induced an upregulation of activation marker. Shown is the percentage of CD70) (FIG. 3A and FIG. 3B), CD80 (FIG. 3C and FIG. 3D), CD83 (FIG. 3E and FIG. 3F) and CD86 (FIG. 3G and FIG. 3H) positive vital B cells after 2 days incubation with the indicated titrated antibodies. The x-axis shows the concentration of antibody constructs. The effect on NIH/3T3-FAP cells is shown In FIG. 3A, FIG. 3C, FIG. 3E and FIG. 3G, respectively, while the effect on NIH/3T3-wt cells is shown in FIG. 3B, FIG. 3D, FIG. 3F and FIG. 3H, respectively.

FIG. 4A, FIG. 4B, FIG. 4C, FIG. 4D, FIG. 4E, FIG. 4F and FIG. 5A, FIG. 5B, FIG. 5C, FIG. 5D, FIG. 5E, FIG. 5F, FIG. 5G, FIG. 5H show the in vitro activation of human B cells by mono- or bivalent FAP-targeted human anti-CD40) constructs in the presence of FAP-coated or uncoated DYNABEADS® after 2 days (FIG. 4A, FIG. 4B, FIG. 4C, FIG. 4D, FIG. 4E, FIG. 4F) or 5 days incubation (FIG. 5A, FIG. 5B, FIG. 5C, FIG. 5D, FIG. 5E, FIG. 5F, FIG. 5G, FIG. 5H). After 2 days incubation with FAP-coated beads the bispecific antibodies monovalent for FAP induced a similar increase of B cell activation marker expression (CD70, CD83, and CD86) as the bivalent FAP-targeted molecules. Moreover, the B cell activation marker upregulation by FAP-targeted bispecific antigen-binding molecules was comparable to the upregulation induced 10) by the FAP-independent positive control antibodies. In the absence of FAP (uncoated beads) no increase of B cell activation markers could be observed with the bispecific antigen binding molecules, while positive control antibodies induced an upregulation of activation markers. After 5 days B cell incubation with FAP-coated DYNABEADS® FAP-targeted human anti-CD40) constructs induced a FAP-dependent upregulation of CD80 and CD86 expression on B cells. Compared to the FAP-independent upregulation of CD86 induced by RO7009789 or cross-20 linked SGN-40. CD86 upregulation induced by FAP-dependent bispecific antigen binding molecules was slightly lower. For CD70 and CD83 no or only very limited upregulation could be observed with the bispecific antibodies targeting FAP and CD40, while the positive control antibodies clearly showed an effect on these B cell activation markers. Shown is the percentage of CD70 (FIG. 4A, FIG. 4B, FIG. 5A and FIG. 5B, respectively), CD80 (FIG. 5C and FIG. 5D), CD83 (FIG. 4C, FIG. 4D, FIG. 5E and FIG. 5F, respectively) and CD86 (FIG. 4E, FIG. 4F, FIG. 5G and FIG. 5H, respectively) positive vital B cells after 2 days or 5 days incubation with the indicated titrated antibodies. The x-axis shows the concentration of antibody constructs.

FIG. 7A, FIG. 7B, FIG. 7C, FIG. 7D, FIG. 7E, FIG. 7F, FIG. 7G, FIG. 7H show the in vitro activation of human monocyte-derived DCs (moDCs) by mono- or bivalent FAP-targeted human anti-CD40) constructs in the presence of FAP-coated or uncoated DYNABEADS®, after 2 days incubation. In the presence of FAP-coated beads the bispecific antibody monovalent for FAP induced a similar increase of DC activation marker expression (CD70, CD80, and CD83) as the bivalent FAP-targeted molecule, whereas in the absence of FAP (uncoated beads) no activation marker upregulation was detected. Moreover, the upregulation of CD80 and CD83 by FAP-targeted bispecific antigen-binding molecules was comparable to the upregulation induced by the FAP-independent positive control antibodies. A higher upregulation of CD70 on DCs was observed for RO709789 compared to all other tested antibodies. In contrast. CD86 expression was not significantly changed on DCs incubated with the different anti-CD40) antibodies compared to untreated DCs. Shown is the percentage of CD70 (FIG. 7A and FIG. 7B), CD80) (FIG. 7C and FIG. 7D). CD83 (FIG. 7E and FIG. 7F) and CD86 (FIG. 7G and FIG. 7H) positive vital moDCs after 2 days incubation with the indicated titrated antibodies. The x-axis shows the concentration of antibody constructs.

FIG. 8A and FIG. 8B show the in vitro activation of HEK-Blue™ CD40L cells by mono- or bivalent FAP-targeted human anti-CD40) constructs in the presence of FAP-coated or uncoated DYNABEADS® after 8 hours incubation. In the presence of FAP-coated beads the bispecific antibody monovalent for FAP and bivalent for CD40 induced a similar increase of SEAP production as the bispecific antibody bivalent for FAP and CD40, whereas in the absence of FAP (uncoated beads) no SEAP production was detected. Moreover, an upregulation of SEAP production by FAP-targeted antibodies tetravalent for CD40 was observed in the presence of FAP. However. SEAP production was also observed in the absence of FAP in the supernatant of reporter cells treated with FAP-targeted antibodies tetravalent for CD40. The negative control antibodies tetravalent for human CD40) with one or two DP47 domains instead of a FAP binding domain induced comparable SEAP production in HEK-Blue™ CD40L cells in the presence and absence of FAP and the positive control antibody SGN-40+F (ab) induced similar levels of SEAP production as compared to FAP-targeted bispecific antibodies bivalent or tetravalent for human CD40) in the presence of FAP-coated beads. Shown is the absorption at a wavelength of 650 nm which correlates with the amount of hydrolyzed substrate by SEAP. The x-axis shows the concentration of antibody constructs.

FIG. 15A, FIG. 15B, FIG. 15C, FIG. 15D, FIG. 15E, FIG. 15F, FIG. 15G show schematic representations of the bispecific antigen binding molecules which specifically bind to human CD40) and to FAP or DP47. FIG. 15A shows a schematic representation of a bispecific CD40-DP47 antibody in the 4+1 format consisting of four CD40 binding Fab domains combined with one DP47 binding moiety with VH at the C-terminus of one heavy chain and VL at the C-terminus of the other heavy chain (tetravalent for CD40) and monovalent for DP47). The black point symbolizes knob-into-hole mutations. FIG. 15B shows a schematic representation of a bispecific CD40-DP47 antibody in the 4+2 format consisting of four CD40 binding Fab domains combined with two DP47 binding Fab domains fused each at the C-terminus of the heavy chains (tetravalent for CD40) and bivalent for DP47). FIG. 15C shows a schematic representation of a bispecific CD40-FAP antibody in the 1+1 format consisting of one CD40 binding arm combined with one FAP binding arm (monovalent for CD40) and monovalent for FAP). FIG. 15D shows a schematic scheme of an exemplary bispecific CD40-FAP antibody in the 2+1 format consisting 10) of two CD40 binding Fab domains combined with one FAP binding Fab domain as part of one of the two CD40 binding arms. FIG. 15E shows a schematic representation of a bispecific CD40-FAP antibody in the 4+1 format consisting of four CD40 binding Fab domains combined with one FAP binding Fab domains fused at the C-terminus of one of the heavy chains (tetravalent for CD40) and monovalent for FAP). FIG. 15F shows a schematic representation of a bispecific CD40)-FAP antibody in the 4+1 format consisting of four CD40 binding Fab domains combined with one FAP binding Fab domains fused at the C-terminus of one of the heavy chains. The VH2a and VL2a CD40) binding domains were obtained from an in-house humanization of the murine S2C6 CD40) binding domain. FIG. 15G shows a schematic representation of a bispecific CD40-FAP antibody in the 4+1 format consisting of four CD40 binding Fab domains combined with one FAP binding Fab domains fused at the C-terminus of one of the heavy chains. The VH2d and VL2a CD40) binding domains were obtained from an in-house humanization of the murine S2C6 CD40) binding domain. FIG. 15H shows a schematic representation of a bispecific CD40-FAP antibodies in the 2+1 format consisting of two CD40 binding moieties combined with one FAP binding moiety as crossover fab fragment, wherein the VL-CH1 chain is fused at the C-terminus of the Fc knob chain. FIG. 15I shows a schematic representation of a bispecific CD40-FAP antibodies in the 2+1 format consisting of two CD40 binding moieties combined with one FAP binding moiety as crossover fab fragment, wherein the VH-CL chain is fused at the C-terminus of the Fc knob chain.

FIG. 16B shows a schematic representation of a bispecific CD40-FAP antibody in the 4+1 format consisting of four mouse CD40 binding Fab domains combined with one FAP binding moiety with VH at the C-terminus of one heavy chain and VL at the C-terminus of the other heavy chain (tetravalent for CD40) and monovalent for FAP). The black point symbolizes DD/KK mutations in the Fc and binding to Fc receptors is inhibited by D270A/P329G mutations. FIG. 16C shows a schematic representation of a bispecific CD40-FAP antibody in the 4+2 format consisting of four mouse CD40 binding Fab domains combined with two FAP binding Fab domains fused each at the C-terminus of the heavy chains (tetravalent for CD40 and bivalent for FAP). Binding to Fc receptors is inhibited by D270A/P329G mutations. FIG. 16D shows a schematic representation of a bispecific CD40-DP47 antibody in the 4+1 format consisting of four mouse CD40 binding Fab domains combined with one DP47 binding moiety with VH at the C-terminus of one heavy chain and VL at the C-terminus of the other heavy chain (tetravalent for CD40 and monovalent for DP47). The black point symbolizes DD/KK mutations in the Fc and binding to Fc receptors is inhibited by D270A/P329G mutations. FIG. 16E shows a schematic representation of a bispecific CD40-DP47 antibody in the 4+2 format consisting of four mouse CD40 binding Fab domains combined with two DP47 binding Fab domains fused each at the C-terminus of the heavy chains (tetravalent for CD40) and bivalent for DP47). Binding to Fc receptors is inhibited by D270A/P329G mutations.

FIG. 19A and FIG. 19B show the in vitro activation of HEK-Blue™ CD40L cells by mono- or bivalent FAP-targeted human anti-CD40 constructs in the presence of FAP-coated (FIG. 19A) or uncoated DYNABEADS® (FIG. 19B) after 24 hours incubation. In the presence of FAP-coated beads the bispecific antibody monovalent for FAP and mono- or bivalent for CD40) induced a similar increase of SEAP production as the bispecific antibody bivalent for FAP and CD40), whereas in the absence of FAP (uncoated beads) no or low SEAP production was detected. Moreover, an upregulation of SEAP production by FAP-targeted antibodies tetravalent for CD40) was observed in the presence of FAP. However. SEAP production was also observed in the absence of FAP in the supernatant of reporter cells treated with FAP-targeted antibodies tetravalent for CD40). The negative control antibody tetravalent for human CD40) with one DP47 domain instead of a FAP binding domain induced comparable SEAP production in HEK-Blue™ CD40L cells in the presence and absence of FAP and the positive control antibody P1AD4470)+F (ab) induced similar levels of SEAP production as compared to FAP-targeted bispecific antibodies bivalent or tetravalent for human CD40) in the presence of FAP-coated beads. Shown is the absorption at a wavelength of 650 nm which correlates with the amount of hydrolyzed substrate by SEAP. The x-axis shows the concentration of antibody constructs. The $EC_{50}$ values of HEK-Blue™ CD40L cell activation in the presence of FAP-coated beads are summarized in Table 11. The $EC_{50}$ values of all tested antibodies tetravalent for CD40 were comparable and lower compared to the $EC_{50}$ values of the depicted antibodies bivalent for CD40. The highest $EC_{50}$ value was detected for the 1+1 format.

FIG. 20A and FIG. 20B show the in vitro activation of human Daudi cells by mono- or bivalent FAP-targeted human anti-CD40) constructs in the presence of FAP-coated (FIG. 20A) or uncoated DYNABEADS® (FIG. 20B) after 2 days incubation. With FAP-coated beads the bispecific antibodies monovalent for FAP induced a similar increase of the B cell activation marker expression CD70) as the bivalent FAP-targeted molecules. Moreover, the B cell activation marker upregulation by FAP-targeted bispecific antigen-binding molecules was higher comparable to the upregulation induced by the FAP-independent positive control antibodies. In the absence of FAP (uncoated beads) no increase of CD70) could be observed with the depicted FAP-targeted bispecific antibodies mono- or bivalent for CD40, while tetravalent CD40 binding molecules induce an upregulation of CD70, but to a lesser extent than in the presence of FAP. Shown is the percentage of CD70 positive vital Daudi cells after 2 days incubation with the indicated titrated antibodies. The x-axis shows the concentration of antibody constructs. The $EC_{50}$ values of activation in the presence of FAP-coated beads are summarized in Table 9. The $EC_{50}$ values of all FAP-targeted antibodies tetravalent for CD40) were comparable and lower compared to the $EC_{50}$ values of the depicted antibodies bivalent for CD40. The highest $EC_{50}$ values were detected for the positive control antibody P1AD4470) and the 1+1 format. FIG. 21A and FIG. 21B show the in vitro activation of human B cells by mono- or bivalent FAP-targeted human anti-CD40) constructs in the presence of FAP-coated (FIG. 21A) or uncoated DYNABEADS®. (FIG. 21B) after 2 days incubation. With FAP-coated beads the bispecific antibodies monovalent for FAP induced a similar increase of the B cell activation marker expression CD86 as the bivalent FAP-targeted molecules. Compared to the FAP-independent upregulation of CD86 induced by cross-linked CD40 antibody (P1AD4470). CD86 upregulation induced by FAP-dependent bispecific antigen binding molecules was slightly lower. In the absence of FAP (uncoated beads) no increase of CD86 expression could be observed with the bispecific antigen binding molecules, while positive control antibodies induced an upregulation 10) of activation markers. Shown is the percentage of CD86 positive vital B cells after 2 days incubation with the indicated titrated antibodies. The x-axis shows the concentration of antibody constructs. The $EC_{50}$ values of activation in the presence of FAP-coated beads are summarized in Table 10. The $EC_{50}$ values of all FAP-targeted antibodies tetravalent for CD40 were comparable and lower compared to the $EC_{50}$ values of the depicted FAP-targeted antibodies bivalent for CD40. The highest $EC_{50}$ values were detected for the 2+1, 2+2, and 1+1 format.

FIG. 23A, FIG. 23B, FIG. 23C, FIG. 23D, FIG. 23E and FIG. 24A, FIG. 24B, FIG. 24C, FIG. 24D show enzyme serum levels, body weight, spleen weight. DC activation and T cell proliferation in mice injected with a FAP-expressing murine colon adenocarcinoma tumor cell line (MC38-FAP) and treated with either FGK4.5 (P1AD3449) or FGK4.5× FAP 4+1 (P1AD4520)) or vehicle alone. In contrast to mice treated with non-targeted CD40 mAb (FGK4.5), treatment with FAP-CD40) (FGK4.5) 4+1, (i.e. a bispecific antibody tetravalent for CD40) and monovalent for FAP) did not induce liver injury as no increase in serum enzymes indicative of liver injury was observed. This is shown for 3 animals per group in FIG. 23A for alanine aminotransferase (ALT), in FIG. 23B for glutamate dehydrogenase (GDH) and in FIG. 23C for sorbitol dehydrogenase (SDH). Moreover, no decrease in body weight (FIG. 23D) and less increase in spleen weight (FIG. 23E) was observed in mice treated with FGK4.5×FAP (P1AD4520) compared to mice treated with the parental untargeted CD40 antibody (P1AD3449). DC activation in the tumor-draining lymph nodes three days post therapy injection (FIG. 24A and FIG. 24B) and T cell proliferation in tumor eight days post therapy injection (FIG. 24C and FIG. 24D) was significantly increased in FGK4.5- and FGK4.5×FAP 4+1-treated animals compared to vehicle-treated animals. In FIG. 23A, FIG. 23B, and FIG. 23C the y-axis shows serum enzyme levels in units per liter and the x-axis shows individual mice treated with FGK4.5, FGK4.5×FAP 4+1 or vehicle alone. In FIG. 23D the y-axis shows the body weight in gram of mice treated FGK4.5. FGK4.5×FAP 4+1 or vehicle alone and the x-axis shows the days post tumor injection. FIG. 23E shows the spleen weight of mice treated with FGK4.5. FGK4.5×FAP 4+1 or vehicle alone three days post therapy injection. FIG. 24A, FIG. 24B, FIG. 24C, and FIG. 24D show the CD86 (FIG. 24A) and CD70 expression (FIG. 24B) of DCs in the tumor-draining lymph node and the Ki67 expression of CD8+ T cells (FIG. 24C) and the total numbers of CD8+ T cell (FIG. 24D) in the tumor three and eight days post therapy injection, respectively. ((*$p<0.05$.  $p<0.01$. * $p<0.001$, unpaired, two-tailed Student's test).

DETAILED DESCRIPTION OF THE INVENTION

Definitions

Figure 1C:
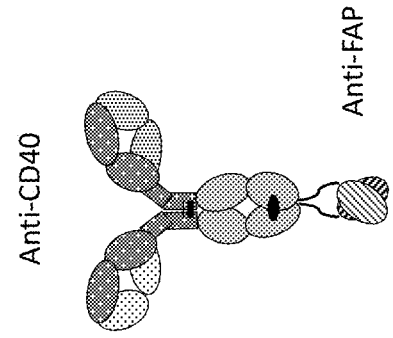
FIG. 1A, FIG. 1B, FIG. 1C, FIG. 1D, FIG. 1F show schematic representations of the bispecific antigen binding molecules which specifically bind to human CD40 and to FAP.

Unless defined otherwise, technical and scientific terms used herein have the same meaning as generally used in the art to which this invention belongs. For purposes of interpreting this specification, the following definitions will apply and whenever appropriate, terms used in the singular will also include the plural and vice versa.

As used herein, the term "antigen binding molecule" refers in its broadest sense to a molecule that specifically binds an antigenic determinant. Examples of antigen binding molecules are antibodies, antibody fragments and scaffold antigen binding proteins.

As used herein, the term "antigen binding domain capable of specific binding to a target cell antigen" or "moiety capable of specific binding to a target cell antigen" refers to a polypeptide molecule that specifically binds to an antigenic determinant. In one aspect, the antigen binding domain is able to activate signaling through its target cell antigen. In a particular aspect, the antigen binding domain is able to direct the entity to which it is attached (e.g. the CD40 agonist) to a target site, for example to a specific type of tumor cell or tumor stroma bearing the antigenic determinant. Antigen binding domains capable of specific binding to a target cell antigen include antibodies and fragments thereof as further defined herein. In addition, antigen binding domains capable of specific binding to a target cell antigen include scaffold antigen binding proteins as further defined herein, e.g. binding domains which are based on designed repeat proteins or designed repeat domains (see e.g. WO 2002/020565).

In relation to an antibody or fragment thereof, the term "antigen binding domain capable of specific binding to a target cell antigen" refers to the part of the molecule that comprises the area which specifically binds to and is complementary to part or all of an antigen. A antigen binding domain capable of specific antigen binding may be provided, for example, by one or more antibody variable domains (also called antibody variable regions). Particularly, an antigen binding domain capable of specific antigen binding comprises an antibody light chain variable region (VL) and an antibody heavy chain variable region (VH). In another aspect, the "antigen binding domain capable of specific binding to a target cell antigen" can also be a Fab fragment or a cross-Fab fragment.

The term "antibody" herein is used in the broadest sense and encompasses various antibody structures, including but not limited to monoclonal antibodies, polyclonal antibodies, monospecific and multispecific antibodies (e.g., bispecific antibodies), and antibody fragments so long as they exhibit the desired antigen-binding activity.

The term "monoclonal antibody" as used herein refers to an antibody obtained from a population of substantially homogeneous antibodies, i.e., the individual antibodies comprising the population are identical and/or bind the same epitope, except for possible variant antibodies. e.g. containing naturally occurring mutations or arising during production of a monoclonal antibody preparation, such variants generally being present in minor amounts. In contrast to polyclonal antibody preparations, which typically include different antibodies directed against different determinants (epitopes), each monoclonal antibody of a monoclonal antibody preparation is directed against a single determinant on an antigen.

The term "monospecific" antibody as used herein denotes an antibody that has one or more binding sites each of which bind to the same epitope of the same antigen. The term "bispecific" means that the antigen binding molecule is able to specifically bind to at least two distinct antigenic determinants. Typically, a bispecific antigen binding molecule comprises two antigen binding sites, each of which is specific for a different antigenic determinant. In certain embodiments the bispecific antigen binding molecule is capable of simultaneously binding two antigenic determinants, particularly two antigenic determinants expressed on two distinct cells. A bispecific antigen binding molecule as described herein can also form part of a multispecific antibody.

The term "valent" as used within the current application denotes the presence of a specified number of binding sites specific for one distinct antigenic determinant in an antigen binding molecule that are specific for one distinct antigenic determinant. As such, the terms "bivalent". "tetravalent", and "hexavalent" denote the presence of two binding sites, four binding sites, and six binding sites specific for a certain antigenic determinant, respectively, in an antigen binding molecule. In particular aspects of the invention, the bispecific antigen binding molecules according to the invention can be monovalent for a certain antigenic determinant, meaning that they have only one binding site for said antigenic determinant or they can be bivalent or tetravalent for a certain antigenic determinant, meaning that they have two binding sites or four binding sites, respectively, for said antigenic determinant.

The terms "full length antibody". "intact antibody", and "whole antibody" are used herein interchangeably to refer to an antibody having a structure substantially similar to a native antibody structure. "Native antibodies" refer to naturally occurring immunoglobulin molecules with varying structures. For example, native IgG-class antibodies are heterotetrameric glycoproteins of about 150.000 daltons, composed of two light chains and two heavy chains that are disulfide-bonded. From N- to C-terminus, each heavy chain has a variable region (VH), also called a variable heavy domain or a heavy chain variable domain, followed by three constant domains (CH1, CH2, and CH3), also called a heavy chain constant region. Similarly, from N- to C-terminus, each light chain has a variable region (VL), also called a variable light domain or a light chain variable domain, followed by a light chain constant domain (CL), also called a light chain constant region. The heavy chain of an antibody may be assigned to one of five types, called α (IgA), δ (IgD), ε (IgE), γ (IgG), or μ (IgM), some of which may be further divided into subtypes, e.g. γ1 (IgG1), γ2 (IgG2), γ3 (IgG3), γ4 (IgG4), α1 (IgA1) and α2 (IgA2). The light chain of an antibody may be assigned to one of two types, called kappa (κ) and lambda (λ), based on the amino acid sequence of its constant domain.

An "antibody fragment" refers to a molecule other than an intact antibody that comprises a portion of an intact antibody that binds the antigen to which the intact antibody binds. Examples of antibody fragments include but are not limited to Fv, Fab, Fab', Fab-SH, F(ab')$_2$; diabodies, triabodies, tetrabodies, cross-Fab fragments; linear antibodies: single-chain antibody molecules (e.g. scFv); and single domain antibodies. For a review of certain antibody fragments, see Hudson et al., Nat Med 9, 129-134 (2003). For a review of scFv fragments, see e.g. Plückthun, in The Pharmacology of Monoclonal Antibodies, vol. 113. Rosenburg and Moore eds., Springer-Verlag. New York, pp. 269-315 (1994): see also WO 93/16185; and U.S. Pat. Nos. 5,571,894 and 5.587.458. For discussion of Fab and F(ab')2 fragments comprising salvage receptor binding epitope residues and having increased in vivo half-life, see U.S. Pat. No. 5,869,046, Diabodies are antibody fragments with two antigen-binding sites that may be bivalent or bispecific, see, for example, EP 404.097: WO 1993/01161: Hudson et al., Nat Med 9, 129-134 (2003); and Hollinger et al., Proc Natl Acad Sci USA 90, 6444-6448 (1993). Triabodies and tetrabodies are also described in Hudson et al., Nat Med 9, 129-134 (2003), Single-domain antibodies are antibody fragments comprising all or a portion of the heavy chain variable domain or all or a portion of the light chain variable domain of an antibody. In certain embodiments, a single-domain antibody is a human single-domain antibody (Domantis. Inc., Waltham. MA: see e.g. U.S. Pat. No. 6,248,516 B1). Antibody fragments can be made by various techniques, including but not limited to proteolytic digestion of an intact antibody as well as production by recombinant host cells (e.g. E, coli or phage), as described herein.

Papain digestion of intact antibodies produces two identical antigen-binding fragments, called "Fab" fragments containing each the heavy- and light-chain variable domains and also the constant domain of the light chain and the first constant domain (CH1) of the heavy chain. As used herein. Thus, the term "Fab fragment" refers to an antibody fragment comprising a light chain fragment comprising a VL domain and a constant domain of a light chain (CL), and a VH domain and a first constant domain (CH1) of a heavy chain. Fab' fragments differ from Fab fragments by the addition of a few residues at the carboxy terminus of the heavy chain CH1 domain including one or more cysteines from the antibody hinge region. Fab-SH are Fab' fragments wherein the cysteine residue(s) of the constant domains bear a free thiol group. Pepsin treatment yields an F(ab')$_2$ fragment that has two antigen-combining sites (two Fab fragments) and a part of the Fc region. According to the present invention, the term "Fab fragment" also includes "cross-Fab fragments" or "crossover Fab fragments" as defined below.

The term "cross-Fab fragment" or "xFab fragment" or "crossover Fab fragment" refers to a Fab fragment, wherein either the variable regions or the constant regions of the heavy and light chain are exchanged. Two different chain compositions of a crossover Fab molecule are possible and comprised in the bispecific antibodies of the invention: On the one hand, the variable regions of the Fab heavy and light chain are exchanged, i.e. the crossover Fab molecule comprises a peptide chain composed of the light chain variable region (VL) and the heavy chain constant region (CH1), and a peptide chain composed of the heavy chain variable region (VH) and the light chain constant region (CL). This crossover Fab molecule is also referred to as CrossFab$_{(VLVH)}$. On the other hand, when the constant regions of the Fab heavy and light chain are exchanged, the crossover Fab molecule comprises a peptide chain composed of the heavy chain variable region (VH) and the light chain constant region (CL), and a peptide chain composed of the light chain variable region (VL) and the heavy chain constant region (CH1). This crossover Fab molecule is also referred to as CrossFab$_{(CLCH1)}$.

A "single chain Fab fragment" or "scFab" is a polypeptide consisting of an antibody heavy chain variable domain (VH), an antibody constant domain 1 (CH1), an antibody light chain variable domain (VL), an antibody light chain constant domain (CL) and a linker, wherein said antibody domains and said linker have one of the following orders in N-terminal to C-terminal direction: a) VH-CH1-linker-VL-CL, b) VL-CL-linker-VH-CH1, c) VH-CL-linker-VL-CH1 or d) VL-CH1-linker-VH-CL; and wherein said linker is a polypeptide of at least 30 amino acids, preferably between 32 and 50 amino acids. Said single chain Fab fragments are stabilized via the natural disulfide bond between the CL domain and the CH1 domain. In addition, these single chain Fab molecules might be further stabilized by generation of interchain disulfide bonds via insertion of cysteine residues (e.g. position 44 in the variable heavy chain and position 100 in the variable light chain according to Kabat numbering).

A "crossover single chain Fab fragment" or "x-scFab" is a is a polypeptide consisting of an antibody heavy chain variable domain (VH), an antibody constant domain 1 (CH1), an antibody light chain variable domain (VL), an antibody light chain constant domain (CL) and a linker, wherein said antibody domains and said linker have one of the following orders in N-terminal to C-terminal direction: a) VH-CL-linker-VL-CH1 and b) VL-CH1-linker-VH-CL; wherein VH and VL form together an antigen-binding site which binds specifically to an antigen and wherein said linker is a polypeptide of at least 30 amino acids. In addition, these x-scFab molecules might be further stabilized by generation of interchain disulfide bonds via insertion of cysteine residues (e.g. position 44 in the variable heavy chain and position 100 in the variable light chain according to Kabat numbering).

A "single-chain variable fragment (scFv)" is a fusion protein of the variable regions of the heavy ($V_H$) and light chains ($V_L$) of an antibody, connected with a short linker peptide of ten to about 25 amino acids. The linker is usually rich in glycine for flexibility, as well as serine or threonine for solubility, and can either connect the N-terminus of the $V_H$ with the C-terminus of the $V_L$, or vice versa. This protein retains the specificity of the original antibody, despite removal of the constant regions and the introduction of the linker, scFv antibodies are, e.g. described in Houston. J. S., Methods in Enzymol. 203 (1991) 46-96). In addition, antibody fragments comprise single chain polypeptides having the characteristics of a VH domain, namely being able to assemble together with a VL domain, or of a VL domain, namely being able to assemble together with a VH domain to a functional antigen binding site and thereby providing the antigen binding property of full length antibodies.

"Scaffold antigen binding proteins" are known in the art, for example, fibronectin and designed ankyrin repeat proteins (DARPins) have been used as alternative scaffolds for antigen-binding domains, see, e.g., Gebauer and Skerra. Engineered protein scaffolds as next-generation antibody therapeutics. Curr Opin Chem Biol 13:245-255 (2009) and Stumpp et al., Darpins; A new generation of protein therapeutics. Drug Discovery Today 13:695-701 (2008). In one aspect of the invention, a scaffold antigen binding protein is selected from the group consisting of CTLA-4 (Evibody). Lipocalins (Anticalin), a Protein A-derived molecule such as Z-domain of Protein A (Affibody), an A-domain (Avimer/Maxibody), a serum transferrin (trans-body); a designed ankyrin repeat protein (DARPin), a variable domain of antibody light chain or heavy chain (single-domain antibody, sdAb), a variable domain of antibody heavy chain (nanobody, aVH). VNAR fragments, a fibronectin (AdNectin), a C-type lectin domain (Tetranectin); a variable domain of a new antigen receptor beta-lactamase (VNAR fragments), a human gamma-crystallin or ubiquitin (Affilin molecules): a kunitz type domain of human protease inhibitors, microbodies such as the proteins from the knottin family, peptide aptamers and fibronectin (adnectin). CTLA-4 (Cytotoxic T Lymphocyte-associated Antigen 4) is a CD28-family receptor expressed on mainly CD4' T-cells. Its extracellular domain has a variable domain-like Ig fold. Loops corresponding to CDRs of antibodies can be substituted with heterologous sequence to confer different binding properties. CTLA-4 molecules engineered to have different binding specificities are also known as Evibodies (e.g. U.S. Pat. No. 7,166,697B1). Evibodies are around the same size as the isolated variable region of an antibody (e.g. a domain antibody). For further details see Journal of Immunological Methods 248 (1-2). 31-45 (2001). Lipocalins are a family of extracellular proteins which transport small hydrophobic molecules such as steroids, bilins, retinoids and lipids. They have a rigid beta-sheet secondary structure with a number of loops at the open end of the conical structure which can be engineered to bind to different target antigens. Anticalins are between 160-180 amino acids in size, and are derived from lipocalins. For further details see Biochim Biophys Acta 1482:337-350 (2000). U.S. Pat. No. 7,250,297B1 and US20070224633. An affibody is a scaffold derived from Protein A of Staphylococcus aureus which can be engineered to bind to antigen. The domain consists of a three-helical bundle of approximately 58 amino acids. Libraries have been generated by randomization of surface residues. For further details see Protein Eng. Des. Sel. 2004, 17, 455-462 and EP 1641818A1. Avimers are multidomain proteins derived from the A-domain scaffold family. The native domains of approximately 35 amino acids adopt a defined disulfide bonded structure. Diversity is generated by shuffling of the natural variation exhibited by the family of A-domains. For further details see Nature Biotechnology 23 (12). 1556-1561 (2005) and Expert Opinion on Investigational Drugs 16 (6). 909-917 (June 2007). A transferrin is a monomeric serum transport glycoprotein. Transferrins can be engineered to bind different target antigens by insertion of peptide sequences in a permissive surface loop. Examples of engineered transferrin scaffolds include the Trans-body. For further details see J. Biol. Chem 274, 24066-24073 (1999). Designed Ankyrin Repeat Proteins (DARPins) are derived from Ankyrin which is a family of proteins that mediate attachment of integral membrane proteins to the cytoskeleton. A single ankyrin repeat is a 33 residue motif consisting of two alpha-helices and a beta-turn. They can be engineered to bind different target antigens by randomizing residues in the first alpha-helix and a beta-turn of each repeat. Their binding interface can be increased by increasing the number of modules (a method of affinity maturation). For further details see J. Mol. Biol. 332, 489-503 (2003). PNAS 100 (4). 1700-1705 (2003) and J. Mol. Biol. 369, 1015-1028 (2007) and US20040132028A1. A single-domain antibody is an antibody fragment consisting of a single monomeric variable antibody domain. The first single domains were derived from the variable domain of the antibody heavy chain from camelids (nanobodies or $V_HH$ fragments). Furthermore, the term single-domain antibody includes an autonomous human heavy chain variable domain (aVH) or VNAR fragments derived from sharks. Fibronectin is a scaffold which can be engineered to bind to antigen. Adnectins consists of a backbone of the natural amino acid sequence of the 10th domain of the 15 repeating units of human fibronectin type III (FN3). Three loops at one end of the, beta.-sandwich can be engineered to enable an Adnectin to specifically recognize a therapeutic target of interest. For further details see Protein Eng. Des. Sel. 18, 435-444 (2005), US20080139791. WO2005056764 and U.S. Pat. No. 6,818,418B1, Peptide aptamers are combinatorial recognition molecules that consist of a constant scaffold protein, typically thioredoxin (TrxA) which contains a constrained variable peptide loop inserted at the active site. For further details see Expert Opin. Biol. Ther. 5, 783-797 (2005). Microbodies are derived from naturally occurring microproteins of 25-50) amino acids in length which contain 3-4 cysteine bridges—examples of microproteins include KalataBI and conotoxin and knottins. The microproteins have a loop which can beengineered to include up to 25 amino acids without affecting the overall fold of the microprotein. For further details of engineered knottin domains, see WO2008098796.

An "antigen binding molecule that binds to the same epitope" as a reference molecule refers to an antigen binding molecule that blocks binding of the reference molecule to its antigen in a competition assay by 50% or more, and conversely, the reference molecule blocks binding of the antigen binding molecule to its antigen in a competition assay by 50% or more.

The term "antigen binding domain" or "antigen-binding site" refers to the part of an antigen binding molecule that comprises the area which specifically binds to and is complementary to part or all of an antigen. Where an antigen is large, an antigen binding molecule may only bind to a particular part of the antigen, which part is termed an epitope. An antigen binding domain may be provided by, for example, one or more variable domains (also called variable regions). Preferably, an antigen binding domain comprises an antibody light chain variable region (VL) and an antibody heavy chain variable region (VH).

As used herein, the term "antigenic determinant" is synonymous with "antigen" and "epitope." and refers to a site (e.g. a contiguous stretch of amino acids or a conformational configuration made up of different regions of non-contiguous amino acids) on a polypeptide macromolecule to which an antigen binding moiety binds, forming an antigen binding moiety-antigen complex. Useful antigenic determinants can be found, for example, on the surfaces of tumor cells, on the surfaces of virus-infected cells, on the surfaces of other diseased cells, on the surface of immune cells, free in blood serum, and/or in the extracellular matrix (ECM). The proteins useful as antigens herein can be any native form the proteins from any vertebrate source, including mammals such as primates (e.g. humans) and rodents (e.g. mice and rats), unless otherwise indicated. In a particular embodiment the antigen is a human protein. Where reference is made to a specific protein herein, the term encompasses the "full-length", unprocessed protein as well as any form of the protein that results from processing in the cell. The term also encompasses naturally occurring variants of the protein, e.g. splice variants or allelic variants.

By "specific binding" is meant that the binding is selective for the antigen and can be discriminated from unwanted or non-specific interactions. The ability of an antigen binding molecule to bind to a specific antigen can be measured either through an enzyme-linked immunosorbent assay (ELISA) or other techniques familiar to one of skill in the art, e.g. Surface Plasmon Resonance (SPR) technique (analyzed on a BIACORE® instrument) (Liljeblad et al., Glyco J 17, 323-329 (2000)), and traditional binding assays (Heeley, Endocr Res 28, 217-229 (2002)). In one embodiment, the extent of binding of an antigen binding molecule to an unrelated protein is less than about 10% of the binding of the antigen binding molecule to the antigen as measured, e.g. by SPR. In certain embodiments, an molecule that binds to the antigen has a dissociation constant (Kd) of $\leq 1$ μM, $\leq 100$ nM, $\leq 10$ nM, $\leq 1$ nM, $\leq 0.1$ nM, $\leq 0.01$ nM, or $\leq 0.001$ nM (e.g. $10^{-8}$ M or less, e.g. from $10^{-8}$ M to $10^{-13}$ M, e.g. from $10^{-9}$ M to $10^{-13}$ M).

"Affinity" or "binding affinity" refers to the strength of the sum total of non-covalent interactions between a single binding site of a molecule (e.g. an antibody) and its binding partner (e.g. an antigen). Unless indicated otherwise, as used herein. "binding affinity" refers to intrinsic binding affinity which reflects a 1:1 interaction between members of a binding pair (e.g. antibody and antigen). The affinity of a molecule X for its partner Y can generally be represented by the dissociation constant (Kd), which is the ratio of dissociation and association rate constants (koff and kon, respectively). Thus, equivalent affinities may comprise different rate constants, as long as the ratio of the rate constants remains the same. Affinity can be measured by common methods known in the art, including those described herein. A particular method for measuring affinity is Surface Plasmon Resonance (SPR).

An "affinity matured" antibody refers to an antibody with one or more alterations in one or more hypervariable regions (HVRs), compared to a parent antibody which does not possess such alterations, such alterations resulting in an improvement in the affinity of the antibody for antigen.

A "target cell antigen" as used herein refers to an antigenic determinant presented on the surface of a target cell, in particular a target cell in a tumor such as a cancer cell or a cell of the tumor stroma. Thus, the target cell antigen is a tumor-associated antigen. In particular, a target cell antigen does not include immune checkpoint receptors on activated T cells, such as CTLA-4. PD-1 or PD-L1. In certain embodiments, the target cell antigen is an antigen on the surface of a tumor cell. In one aspect, the tumor target cell antigen is selected from the group consisting of Fibroblast Activation Protein (FAP). Carcinoembryonic Antigen (CEA). Melanoma-associated Chondroitin Sulfate Proteoglycan (MCSP). Epidermal Growth Factor Receptor (EGFR). CD19. CD20 and CD33. In particular, the tumor target cell antigen is Fibroblast Activation Protein (FAP).

The term "Fibroblast activation protein (FAP)", also known as Prolyl endopeptidase FAP or Seprase (EC 3.4.21), refers to any native FAP from any vertebrate source, including mammals such as primates (e.g. humans) non-human primates (e.g. cynomolgus monkeys) and rodents (e.g. mice and rats), unless otherwise indicated. The term encompasses "full-length." unprocessed FAP as well as any form of FAP that results from processing in the cell. The term also encompasses naturally occurring variants of FAP, e.g., splice variants or allelic variants. In one embodiment, the antigen binding molecule of the invention is capable of specific binding to human, mouse and/or cynomolgus FAP. The amino acid sequence of human FAP is shown in UniProt (www.uniprot.org) accession no. Q12884 (version 149, SEQ ID NO:2), or NCBI (www.ncbi.nlm.nih.gov/) RefSeq NP_004451.2. The extracellular domain (ECD) of human FAP extends from amino acid position 26 to 760. The amino acid sequence of a His-tagged human FAP ECD is shown in SEQ ID NOs 142. The amino acid sequence of mouse FAP is shown in UniProt accession no. P97321 (version 126, SEQ ID NO:143), or NCBI RefSeq NP_032012.1. The extracellular domain (ECD) of mouse FAP extends from amino acid position 26 to 761. SEQ ID NO: 144 shows the amino acid of a His-tagged mouse FAP ECD. SEQ ID NO: 145 shows the amino acid of a His-tagged cynomolgus FAP ECD. Preferably, an anti-FAP binding molecule of the invention binds to the extracellular domain of FAP.

The term "variable region" or "variable domain" refers to the domain of an antibody heavy or light chain that is involved in binding the antigen binding molecule to antigen. The variable domains of the heavy chain and light chain (VH and VL, respectively) of a native antibody generally have similar structures, with each domain comprising four conserved framework regions (FRs) and three hypervariable regions (HVRs), See, e.g., Kindt et al., Kuby Immunology, 6th ed., W. H. Freeman and Co., page 91 (2007). A single VH or VL domain may be sufficient to confer antigen-binding specificity.

The term "hypervariable region" or "HVR," as used herein refers to each of the regions of an antibody variable domain which are hypervariable in sequence and/or form structurally defined loops ("hypervariable loops"), Generally, native four-chain antibodies comprise six HVRs: three in the VH (H1, H2, H3), and three in the VL (L1, L2, L3). HVRs generally comprise amino acid residues from the hypervariable loops and/or from the "complementarity determining regions" (CDRs), the latter being of highest sequence variability and/or involved in antigen recognition. Exemplary hypervariable loops occur at amino acid residues 26-32 (L1), 50-52 (L2), 91-96 (L3), 26-32 (H1), 53-55 (H2), and 96-101 (H3). (Chothia and Lesk, *J. Mol. Biol.* 196:901-917 (1987).) Exemplary CDRs (CDR-L1, CDR-L2, CDR-L3, CDR-H1, CDR-H2, and CDR-H3) occur at amino acid residues 24-34 of L1, 50-56 of L2, 89-97 of L3, 31-35B of H1, 50-65 of H2, and 95-102 of H3. (Kabat et al., *Sequences of Proteins of Immunological Interest,* 5th Ed. Public Health Service, National Institutes of Health, *Bethesda, MD* (1991).) Hypervariable regions (HVRs) are also referred to as complementarity determining regions (CDRs), and these terms are used herein interchangeably in reference to portions of the variable region that form the antigen binding regions. This particular region has been described by Kabat et al., U.S. Dept, of Health and Human Services, "Sequences of Proteins of Immunological Interest" (1983) and by Chothia et al., *J. Mol. Biol.* 196:901-917 (1987), where the definitions include overlapping or subsets of amino acid residues when compared against each other. Nevertheless, application of either definition to refer to a CDR of an antibody or variants thereof is intended to be within the scope of the term as defined and used herein. The appropriate amino acid residues which encompass the CDRs as defined by each of the above cited references are set forth below in Table A as a comparison. The exact residue numbers which encompass a particular CDR will vary depending on the sequence and size of the CDR. Those skilled in the art can routinely determine which residues comprise a particular CDR given the variable region amino acid sequence of the antibody.

TABLE A

| CDR Definitions[1] | | | |
|---|---|---|---|
| CDR | Kabat | Chothia | AbM[2] |
| $V_H$ CDR1 | 31-35 | 26-32 | 26-35 |
| $V_H$ CDR2 | 50-65 | 52-58 | 50-58 |
| $V_H$ CDR3 | 95-102 | 95-102 | 95-102 |
| $V_L$ CDR1 | 24-34 | 26-32 | 24-34 |
| $V_L$ CDR2 | 50-56 | 50-52 | 50-56 |
| $V_L$ CDR3 | 89-97 | 91-96 | 89-97 |

[1]Numbering of all CDR definitions in Table A is according to the numbering conventions set forth by Kabat et al. (see below).
[2]"AbM" with a lowercase "b" as used in Table A refers to the CDRs as defined by Oxford Molecular's "AbM" antibody modeling software.

Kabat et al, also defined a numbering system for variable region sequences that is applicable to any antibody. One of ordinary skill in the art can unambiguously assign this system of "Kabat numbering" to any variable region sequence, without reliance on any experimental data beyond the sequence itself. As used herein, "Kabat numbering" refers to the numbering system set forth by Kabat et al., U.S. Dept, of Health and Human Services, "Sequence of Proteins of Immunological Interest" (1983). Unless otherwise specified, references to the numbering of specific amino acid residue positions in an antibody variable region are according to the Kabat numbering system.

With the exception of CDR1 in VH, CDRs generally comprise the amino acid residues that form the hypervariable loops. CDRs also comprise "specificity determining residues," or "SDRs." which are residues that contact antigen. SDRs are contained within regions of the CDRs called abbreviated-CDRs, or a-CDRs. Exemplary a-CDRs (a-CDR-L1, a-CDR-L2, a-CDR-L3, a-CDR-H1, a-CDR-H2, and a-CDR-H3) occur at amino acid residues 31-34 of L1, 50-55 of L2, 89-96 of L3, 31-35B of H1, 50-58 of H2, and 95-102 of H3. (See Almagro and Fransson, Front. Biosci. 13:1619-1633 (2008).) Unless otherwise indicated, HVR residues and other residues in the variable domain (e.g., FR residues) are numbered herein according to Kabat et al., supra. "Framework" or "FR" refers to variable domain residues other than hypervariable region (HVR) residues. The FR of a variable domain generally consists of four FR domains; FRI, FR2, FR3, and FR4. Accordingly, the HVR and FR sequences generally appear in the following sequence in VH (or VL): FR1-H1 (L1)-FR2-H2 (L2)-FR3-H3 (L3)-FR4.

The term "chimeric" antibody refers to an antibody in which a portion of the heavy and/or light chain is derived from a particular source or species, while the remainder of the heavy and/or light chain is derived from a different source or species.

The "class" of an antibody refers to the type of constant domain or constant region possessed by its heavy chain. There are five major classes of antibodies: IgA, IgD, IgE, IgG, and IgM, and several of these may be further divided into subclasses (isotypes), e.g. $IgG_1$, $IgG_2$, $IgG_3$, $IgG_4$, $IgA_1$, and $IgA_2$. The heavy chain constant domains that correspond to the different classes of immunoglobulins are called α, δ, ε, γ, and μ respectively.

A "humanized" antibody refers to a chimeric antibody comprising amino acid residues from non-human HVRs and amino acid residues from human FRs. In certain embodiments, a humanized antibody will comprise substantially all of at least one, and typically two, variable domains, in which all or substantially all of the HVRs (e.g., CDRs) correspond to those of a non-human antibody, and all or substantially all of the FRs correspond to those of a human antibody. A humanized antibody optionally may comprise at least a portion of an antibody constant region derived from a human antibody. A "humanized form" of an antibody, e.g., a non-human antibody, refers to an antibody that has undergone humanization. Other forms of "humanized antibodies" encompassed by the present invention are those in which the constant region has been additionally modified or changed from that of the original antibody to generate the properties according to the invention, especially in regard to C1q binding and/or Fc receptor (FcR) binding.

A "human" antibody is one which possesses an amino acid sequence which corresponds to that of an antibody produced by a human or a human cell or derived from a non-human source that utilizes human antibody repertoires or other human antibody-encoding sequences. This definition of a human antibody specifically excludes a humanized antibody comprising non-human antigen-binding residues.

The term "Fc domain" or "Fc region" herein is used to define a C-terminal region of an antibody heavy chain that contains at least a portion of the constant region. The term includes native sequence Fc regions and variant Fc regions. An IgG Fc region comprises an IgG CH2 and an IgG CH3 domain. The "CH2 domain" of a human IgG Fc region usually extends from an amino acid residue at about position 231 to an amino acid residue at about position 340. In one embodiment, a carbohydrate chain is attached to the CH2 domain. The CH2 domain herein may be a native sequence CH2 domain or variant CH2 domain. The "CH3 domain" comprises the stretch of residues C-terminal to a CH2 domain in an Fc region (i.e. from an amino acid residue at about position 341 to an amino acid residue at about position 447 of an IgG). The CH3 region herein may be a native sequence CH3 domain or a variant CH3 domain (e.g. a CH3 domain with an introduced "protuberance" ("knob") in one chain thereof and a corresponding introduced "cavity" ("hole") in the other chain thereof: see U.S. Pat. No. 5,821,333, expressly incorporated herein by reference), Such variant CH3 domains may be used to promote heterodimerization of two non-identical antibody heavy chains as herein described. In one embodiment, a human IgG heavy chain Fc region extends from Cys226, or from Pro230, to the carboxyl-terminus of the heavy chain. However, the C-terminal lysine (Lys447) of the Fc region may or may not be present. Unless otherwise specified herein, numbering of amino acid residues in the Fc region or constant region is according to the EU numbering system, also called the EU index, as described in Kabat et al., Sequences of Proteins of Immunological Interest. 5th Ed. Public Health Service. National Institutes of Health, Bethesda. MD. 1991.

The "knob-into-hole" technology is described e.g. in U.S. Pat. No. 5,731,168: U.S. Pat. No. 7,695,936; Ridgway et al., Prot Eng 9, 617-621 (1996) and Carter. J Immunol Meth 248, 7-15 (2001). Generally, the method involves introducing a protuberance ("knob") at the interface of a first polypeptide and a corresponding cavity ("hole") in the interface of a second polypeptide, such that the protuberance can be positioned in the cavity so as to promote heterodimer formation and hinder homodimer formation. Protuberances are constructed by replacing small amino acid side chains from the interface of the first polypeptide with larger side chains (e.g. tyrosine or tryptophan). Compensatory cavities of identical or similar size to the protuberances are created in the interface of the second polypeptide by replacing large amino acid side chains with smaller ones (e.g. alanine or threonine). The protuberance and cavity can be made by altering the nucleic acid encoding the polypeptides, e.g. by site-specific mutagenesis, or by peptide synthesis. In a specific embodiment a knob modification comprises the amino acid substitution T366W in one of the two subunits of the Fc domain, and the hole modification comprises the amino acid substitutions T366S. L368A and γ407V in the other one of the two subunits of the Fc domain. In a further specific embodiment, the subunit of the Fc domain comprising the knob modification additionally comprises the amino acid substitution S354C, and the subunit of the Fc domain comprising the hole modification additionally comprises the amino acid substitution γ349C. Introduction of these two cysteine residues results in the formation of a disulfide bridge between the two subunits of the Fc region, thus further stabilizing the dimer (Carter, J Immunol Methods 248.7-15 (2001)).

A "region equivalent to the Fc region of an immunoglobulin" is intended to include naturally occurring allelic variants of the Fc region of an immunoglobulin as well as variants having alterations which produce substitutions, additions, or deletions but which do not decrease substantially the ability of the immunoglobulin to mediate effector functions (such as antibody-dependent cellular cytotoxicity). For example, one or more amino acids can be deleted from the N-terminus or C-terminus of the Fc region of an immunoglobulin without substantial loss of biological function. Such variants can be selected according to general rules known in the art so as to have minimal effect on activity (see, e.g., Bowie. J. U. et al., Science 247: 1306-10 (1990)).

The term "effector function" refers to those biological activities attributable to the Fc region of an antibody, which vary with the antibody isotype. Examples of antibody effector functions include: Clq binding and complement dependent cytotoxicity (CDC). Fc receptor binding, antibody-dependent cell-mediated cytotoxicity (ADCC), antibody-dependent cellular phagocytosis (ADCP), cytokine secretion, immune complex-mediated antigen uptake by antigen presenting cells, down regulation of cell surface receptors (e.g. B cell receptor), and B cell activation.

Fc receptor binding dependent effector functions can be mediated by the interaction of the Fc-region of an antibody with Fc receptors (FcRs), which are specialized cell surface receptors on hematopoietic cells. Fc receptors belong to the immunoglobulin superfamily, and have been shown to mediate both the removal of antibody-coated pathogens by phagocytosis of immune complexes, and the lysis of erythrocytes and various other cellular targets (e.g. tumor cells) coated with the corresponding antibody, via antibody dependent cell mediated cytotoxicity (ADCC) (see e.g. Van de Winkel. J. G, and Anderson. C. L., J. Leukoc. Biol. 49 (1991) 511-524). FcRs are defined by their specificity for immunoglobulin isotypes: Fc receptors for IgG antibodies are referred to as FcγR. Fc receptor binding is described e.g. in Ravetch. J. V, and Kinet. J. P., Annu. Rev. Immunol. 9 (1991) 457-492; Capel. P. J., et al., Immunomethods 4 (1994) 25-34; de Haas. M., et al., J. Lab. Clin. Med. 126 (1995) 330-341: and Gessner. J. E., et al., Ann. Hematol. 76 (1998) 231-248.

Cross-linking of receptors for the Fc-region of IgG antibodies (FcγR) triggers a wide variety of effector functions including phagocytosis, antibody-dependent cellular cytotoxicity, and release of inflammatory mediators, as well as immune complex clearance and regulation of antibody production. In humans, three classes of FcγR have been characterized, which are:

FcγRI (CD64) binds monomeric IgG with high affinity and is expressed on macrophages, monocytes, neutrophils and eosinophils. Modification in the Fc-region IgG at least at one of the amino acid residues E233-G236, P238, D265, N297, A327 and P329 (numbering according to EU index of Kabat) reduce binding to FcγRI. IgG2 residues at positions 233-236, substituted into IgG1 and IgG4, reduced binding to FcγRI by 103-fold and eliminated the human monocyte response to antibody-sensitized red blood cells (Armour. K. L., et al., *Eur. J. Immunol.* 29 (1999) 2613-2624).

FcγRII (CD32) binds complexed IgG with medium to low affinity and is widely expressed. This receptor can be divided into two sub-types. FcγRIIA and FcγRIIB. FcγRIIA is found on many cells involved in killing (e.g. macrophages, monocytes, neutrophils) and seems able to activate the killing process. FcγRIIB seems to play a role in inhibitory processes and is found on B cells, macrophages and on mast cells and eosinophils. On B-cells it seems to function to suppress further immunoglobulin production and isotype switching to, for example, the IgE class. On macrophages. FcγRIIB acts to inhibit phagocytosis as mediated through FcγRIIA. On eosinophils and mast cells the B-form may help to suppress activation of these cells through IgE binding to its separate receptor. Reduced binding for FcγRIIA is found e.g. for antibodies comprising an IgG Fc-region with mutations at least at one of the amino acid residues E233-G236, P238, D265, N297, A327, P329, D270, Q295, A327, R292, and K414 (numbering according to EU index of Kabat).

FcγRIII (CD16) binds IgG with medium to low affinity and exists as two types. FcγRIIIA is found on NK cells, macrophages, eosinophils and some monocytes and T cells and mediates ADCC. FcγRIIIB is highly expressed on neutrophils. Reduced binding to FcγRIIIA is found e.g. for antibodies comprising an IgG Fc-region with mutation at least at one of the amino acid residues E233-G236, P238, D265, N297, A327, P329, D270, Q295, A327, S239, E269, E293. γ296. V303. A327. K338 and D376 (numbering according to EU index of Kabat).

Mapping of the binding sites on human IgG1 for Fc receptors, the above mentioned mutation sites and methods for measuring binding to FcγRI and FcγRIIA are described in Shields. R. L., et al. J. Biol. Chem. 276 (2001) 6591-6604.

The term "ADCC" or "antibody-dependent cellular cytotoxicity" is a function mediated by Fc receptor binding and refers to lysis of target cells by an antibody as reported herein in the presence of effector cells. The capacity of the antibody to induce the initial steps mediating ADCC is investigated by measuring their binding to Fcγ receptors expressing cells, such as cells, recombinantly expressing FcγRI and/or FcγRIIA or NK cells (expressing essentially FcγRIIIA). In particular, binding to FcγR on NK cells is measured.

An "activating Fc receptor" is an Fc receptor that following engagement by an Fc region of an antibody elicits signaling events that stimulate the receptor-bearing cell to perform effector functions. Activating Fc receptors include FcγRIIIa (CD16a). FcγRI (CD64). FcγRIIa (CD32), and FcαRI (CD89). A particular activating Fc receptor is human FcγRIIIa (see UniProt accession no. P08637, version 141).

The term "CD40", as used herein, refers to any native CD40 from any vertebrate source, including mammals such as primates (e.g. humans) and rodents (e.g., mice and rats), unless otherwise indicated. The term encompasses "full-length." unprocessed CD40 as well as any form of CD40 that results from processing in the cell. The term also encompasses naturally occurring variants of CD40, e.g., splice variants or allelic variants. The amino acid sequence of an exemplary human CD40 is shown in SEQ ID NO: 1 (UniProt P25942, version 200) and the amino acid sequence of an exemplary mouse CD40 is shown in SEQ ID NO: 146 (UniProt P27512, version 160). The CD40 antigen is a 50 kDa cell surface glycoprotein which belongs to the Tumor Necrosis Factor Receptor (TNF-R) family. (Stamenkovic et al. (1989). EMBO J. 8:1403-10). CD40 is expressed in many normal and tumor cell types, including B lymphocytes, dendritic cells, monocytes, macrophages, thymus epithelium, endothelial cells, fibroblasts, and smooth muscle cells. CD40 is expressed in all B-lymphomas and in 70% of all solid tumors and is up-regulated in antigen presenting cells (APCs) by maturation signals, such as IFN-gamma and GM-CSF. CD40 activation also induces differentiation of monocytes into functional dendritic cells (DCs) and enhances cytolytic activity of NK cells through APC-CD40 induced cytokines. Thus CD40 plays an essential role in the initiation and enhancement of immune responses by inducing maturation of APCs, secretion of helper cytokines, upregulation of costimulatory molecules, and enhancement of effector functions.

The term "CD40 agonist" as used herein includes any moiety that agonizes the CD40/CD40L interaction. CD40 as used in this context refers preferably to human CD40, thus the CD40 agonist is preferably an agonist of human CD40. Typically, the moiety will be an agonistic CD40 antibody or antibody fragment.

The terms "anti-CD40 antibody", "anti-CD40". "CD40 antibody and "an antibody that specifically binds to CD40" refer to an antibody that is capable of binding CD40 with sufficient affinity such that the antibody is useful as a diagnostic and/or therapeutic agent in targeting CD40. In one aspect, the extent of binding of an anti-CD40 antibody to an unrelated, non-CD40) protein is less than about 10% of the binding of the antibody to CD40 as measured, e.g., by a radioimmunoassay (RIA) or flow cytometry (FACS). In certain embodiments, an antibody that binds to CD40 has a dissociation constant ($K_D$) of ≤1 µM, ≤100 nM, ≤10 nM, ≤1 nM, ≤0.1 nM, ≤0.01 nM, or ≤0.001 nM (e.g. 106 M or less, e.g. from 1068 M to $10^{-13}$ M, e.g., from $10^{-8}$ M to $10^{-10}$ M).

The term "peptide linker" refers to a peptide comprising one or more amino acids, typically about 2 to 20 amino acids. Peptide linkers are known in the art or are described herein. Suitable, non-immunogenic linker peptides are, for example, $(G4S)_n$, $(SG_4)_n$ or $G_4(SG_4)_n$ peptide linkers, wherein "n" is generally a number between 1 and 10, typically between 2 and 4, in particular 2, i.e. the peptides selected from the group consisting of GGGGS (SEQ ID NO: 147) GGGGSGGGGS (SEQ ID NO:148), SGGGGSGGGG (SEQ ID NO:149) and GGGGGGGGSGGGG (SEQ ID NO:150), but also include the sequences GSPGSSSSGS (SEQ ID NO: 151), (G4S); (SEQ ID NO:152), $(G4S)_4$ (SEQ ID NO:153), GSGSGSGS (SEQ ID NO: 154), GSGSGNGS (SEQ ID NO:155), GGSGSGSG (SEQ ID NO:156), GGSGSG (SEQ ID NO: 157), GGSG (SEQ ID NO:158), GGSGNGSG (SEQ ID NO:159), GGNGSGSG (SEQ ID NO: 160) and GGNGSG (SEQ ID NO:161). Peptide linkers of particular interest are (G4S) (SEQ ID NO: 147), $(G4S)_2$ or GGGGSGGGGS (SEQ ID NO:148), (G4S); (SEQ ID NO:152) and $(G4S)_4$ (SEQ ID NO:153).

The term "amino acid" as used within this application denotes the group of naturally occurring carboxy α-amino acids comprising alanine (three letter code: ala, one letter code: A), arginine (arg, R), asparagine (asn, N), aspartic acid (asp, D), cysteine (cys, C), glutamine (gln, Q), glutamic acid (glu, E), glycine (gly, G), histidine (his, H), isoleucine (ile, I), leucine (leu, L), lysine (lys, K), methionine (met, M), phenylalanine (phe, F), proline (pro, P), serine (ser, S), threonine (thr, T), tryptophan (trp, W), tyrosine (tyr, Y), and valine (val, V).

By "fused" or "connected" is meant that the components (e.g. a heavy chain of an antibody and a Fab fragment) are linked by peptide bonds, either directly or via one or more peptide linkers.

"Percent (%) amino acid sequence identity" with respect to a reference polypeptide (protein) sequence is defined as the percentage of amino acid residues in a candidate sequence that are identical with the amino acid residues in the reference polypeptide sequence, after aligning the sequences and introducing gaps, if necessary, to achieve the maximum percent sequence identity, and not considering any conservative substitutions as part of the sequence identity. Alignment for purposes of determining percent amino acid sequence identity can be achieved in various ways that are within the skill in the art, for instance, using publicly available computer software such as BLAST, BLAST-2, ALIGN. SAWI or Megalign (DNASTAR) software. Those skilled in the art can determine appropriate parameters for aligning sequences. including any algorithms needed to achieve maximal alignment over the full length of the sequences being compared. For purposes herein, however, % amino acid sequence identity values are generated using the sequence comparison computer program ALIGN-2. The ALIGN-2 sequence comparison computer program was authored by Genentech. Inc., and the source code has been filed with user documentation in the U.S. Copyright Office. Washington D.C., 20559, where it is registered under U.S. Copyright Registration No. TXU510087. The ALIGN-2 program is publicly available from Genentech, Inc., South San Francisco, California, or may be compiled from the source code. The ALIGN-2 program should be compiled for use on a UNIX operating system, including digital UNIX V4.0D. All sequence comparison parameters are set by the ALIGN-2 program and do not vary. In situations where ALIGN-2 is employed for amino acid sequence comparisons, the % amino acid sequence identity of a given amino acid sequence A to, with, or against a given amino acid sequence B (which can alternatively be phrased as a given amino acid sequence A that has or comprises a certain % amino acid sequence identity to, with, or against a given amino acid sequence B) is calculated as follows:

100 times the fraction X/Y where X is the number of amino acid residues scored as identical matches by the sequence alignment program ALIGN-2 in that program's alignment of A and B, and where Y is the total number of amino acid residues in B. It will be appreciated that where the length of amino acid sequence A is not equal to the length of amino acid sequence B, the % amino acid sequence identity of A to B will not equal the % amino acid sequence identity of B to A. Unless specifically stated otherwise, all % amino acid sequence identity values used herein are obtained as described in the immediately preceding paragraph using the ALIGN-2 computer program.

In certain embodiments, amino acid sequence variants of the bispecific antigen binding molecules provided herein are contemplated. For example, it may be desirable to improve the binding affinity and/or other biological properties of the TNF ligand trimer-containing antigen binding molecules. Amino acid sequence variants of the TNF ligand trimer-containing antigen binding molecules may be prepared by introducing appropriate modifications into the nucleotide sequence encoding the molecules, or by peptide synthesis. Such modifications include, for example, deletions from, and/or insertions into and/or substitutions of residues within the amino acid sequences of the antibody. Any combination of deletion, insertion, and substitution can be made to arrive at the final construct, provided that the final construct possesses the desired characteristics, e.g., antigen-binding. Sites of interest for substitutional mutagenesis include the HVRs and Framework (FRs). Conservative substitutions are provided in Table B under the heading "Preferred Substitutions" and further described below in reference to amino acid side chain classes (1) to (6). Amino acid substitutions may be introduced into the molecule of interest and the products screened for a desired activity, e.g., retained/improved antigen binding, decreased immunogenicity, or improved ADCC or CDC.

TABLE B

| Original Residue | Exemplary Substitutions | Preferred Substitutions |
|---|---|---|
| Ala (A) | Val; Leu; Ile | Val |
| Arg (R) | Lys; Gln; Asn | Lys |
| Asn (N) | Gln; His; Asp, Lys; Arg | Gln |
| Asp (D) | Glu; Asn | Glu |

TABLE B-continued

| Original Residue | Exemplary Substitutions | Preferred Substitutions |
|---|---|---|
| Cys (C) | Ser; Ala | Ser |
| Gln (Q) | Asn; Glu | Asn |
| Glu (E) | Asp; Gln | Asp |
| Gly (G) | Ala | Ala |
| His (H) | Asn; Gln; Lys; Arg | Arg |
| Ile (I) | Leu; Val; Met; Ala; Phe; Norleucine | Leu |
| Leu (L) | Norleucine; Ile; Val; Met; Ala; Phe | Ile |
| Lys (K) | Arg; Gln; Asn | Arg |
| Met (M) | Leu; Phe; Ile | Leu |
| Phe (F) | Trp; Leu; Val; Ile; Ala; Tyr | Tyr |
| Pro (P) | Ala | Ala |
| Ser (S) | Thr | Thr |
| Thr (T) | Val; Ser | Ser |
| Trp (W) | Tyr; Phe | Tyr |
| Tyr (Y) | Trp; Phe; Thr; Ser | Phe |
| Val (V) | Ile; Leu; Met; Phe; Ala; Norleucine | Leu |

Amino acids may be grouped according to common side-chain properties:
(1) hydrophobic: Norleucine, Met, Ala, Val, Leu, Ile;
(2) neutral hydrophilic: Cys, Ser, Thr, Asn, Gln;
(3) acidic: Asp, Glu;
(4) basic: His, Lys, Arg;
(5) residues that influence chain orientation: Gly, Pro;
(6) aromatic: Trp, Tyr, Phe.

Non-conservative substitutions will entail exchanging a member of one of these classes for another class.

The term "amino acid sequence variants" includes substantial variants wherein there are amino acid substitutions in one or more hypervariable region residues of a parent antigen binding molecule (e.g. a humanized or human antibody), Generally, the resulting variant(s) selected for further study will have modifications (e.g., improvements) in certain biological properties (e.g., increased affinity, reduced immunogenicity) relative to the parent antigen binding molecule and/or will have substantially retained certain biological properties of the parent antigen binding molecule. An exemplary substitutional variant is an affinity matured antibody, which may be conveniently generated, e.g., using phage display-based affinity maturation techniques such as those described herein. Briefly, one or more HVR residues are mutated and the variant antigen binding molecules displayed on phage and screened for a particular biological activity (e.g. binding affinity). In certain embodiments, substitutions, insertions, or deletions may occur within one or more HVRs so long as such alterations do not substantially reduce the ability of the antigen binding molecule to bind antigen. For example, conservative alterations (e.g., conservative substitutions as provided herein) that do not substantially reduce binding affinity may be made in HVRs. A useful method for identification of residues or regions of an antibody that may be targeted for mutagenesis is called "alanine scanning mutagenesis" as described by Cunningham and Wells (1989) Science, 244:1081-1085. In this method, a residue or group of target residues (e.g., charged residues such as Arg. Asp, His, Lys, and Glu) are identified and replaced by a neutral or negatively charged amino acid (e.g., alanine or polyalanine) to determine whether the interaction of the antibody with antigen is affected. Further substitutions may be introduced at the amino acid locations demonstrating functional sensitivity to the initial substitutions. Alternatively, or additionally, a crystal structure of an antigen-antibody binding molecule complex to identify contact points between the antibody and antigen. Such contact residues and neighboring residues may be targeted or eliminated as candidates for substitution. Variants may be screened to determine whether they contain the desired properties.

Amino acid sequence insertions include amino- and/or carboxyl-terminal fusions ranging in length from one residue to polypeptides containing a hundred or more residues, as well as intrasequence insertions of single or multiple amino acid residues. Examples of terminal insertions include bispecific antigen binding molecules of the invention with an N-terminal methionyl residue. Other insertional variants of the molecule include the fusion to the N- or C-terminus to a polypeptide which increases the serum half-life of the bispecific antigen binding molecules.

In certain embodiments, the bispecific antigen binding molecules provided herein are altered to increase or decrease the extent to which the antibody is glycosylated. Glycosylation variants of the molecules may be conveniently obtained by altering the amino acid sequence such that one or more glycosylation sites is created or removed. Where the TNF ligand trimer-containing antigen binding molecule comprises an Fc region, the carbohydrate attached thereto may be altered. Native antibodies produced by mammalian cells typically comprise a branched, biantennary oligosaccharide that is generally attached by an N-linkage to Asn297 of the CH2 domain of the Fc region. See, e.g., Wright et al. TIBTECH 15:26-32 (1997). The oligosaccharide may include various carbohydrates, e.g., mannose. N-acetyl glucosamine (GlcNAc), galactose, and sialic acid, as well as a fucose attached to a GlcNAc in the "stem" of the biantennary oligosaccharide structure. In some embodiments, modifications of the oligosaccharide in TNF family ligand trimer-containing antigen binding molecule may be made in order to create variants with certain improved properties. In one aspect, variants of bispecific antigen binding molecules or antibodies of the invention are provided having a carbohydrate structure that lacks fucose attached (directly or indirectly) to an Fc region. Such fucosylation variants may have improved ADCC function, see e.g. US Patent Publication Nos. US 2003/0157108 (Presta. L.) or US 2004/0093621 (Kyowa Hakko Kogyo Co., Ltd). In another aspect, variants of the bispecific antigen binding molecules or antibodies of the invention are provided with bisected oligosaccharides, e.g., in which a biantennary oligosaccharide attached to the Fc region is bisected by GlcNAc. Such variants may have reduced fucosylation and/or improved ADCC function, see for example WO 2003/011878 (Jean-Mairet et al.): U.S. Pat. No. 6,602,684 (Umana et al.); and US 2005/0123546 (Umana et al.). Variants with at least one galactose residue in the oligosaccharide attached to the Fc region are also provided. Such antibody variants may have improved CDC function and are described, e.g., in WO 1997/30087 (Patel et al.): WO 1998/58964 (Raju. S.); and WO 1999/22764 (Raju. S.).

In certain aspects, it may be desirable to create cysteine engineered variants of the bispecific antigen binding molecules of the invention, e.g., "thioMAbs." in which one or more residues of the molecule are substituted with cysteine residues. In particular aspects, the substituted residues occur at accessible sites of the molecule. By substituting those residues with cysteine, reactive thiol groups are thereby positioned at accessible sites of the antibody and may be used to conjugate the antibody to other moieties, such as drug moieties or linker-drug moieties, to create an immunoconjugate. In certain aspects, any one or more of the following residues may be substituted with cysteine; V205 (Kabat numbering) of the light chain; A118 (EU numbering) of the heavy chain; and S400 (EU numbering) of the heavy chain Fc region. Cysteine engineered antigen binding molecules may be generated as described, e.g., in U.S. Pat. No. 7,521,541.

The term "polynucleotide" refers to an isolated nucleic acid molecule or construct, e.g. messenger RNA (mRNA), virally-derived RNA, or plasmid DNA (pDNA). A polynucleotide may comprise a conventional phosphodiester bond or a non-conventional bond (e.g. an amide bond, such as found in peptide nucleic acids (PNA). The term "nucleic acid molecule" refers to any one or more nucleic acid segments, e.g. DNA or RNA fragments, present in a polynucleotide.

By "isolated" nucleic acid molecule or polynucleotide is intended a nucleic acid molecule. DNA or RNA, which has been removed from its native environment. For example, a recombinant polynucleotide encoding a polypeptide contained in a vector is considered isolated for the purposes of the present invention. Further examples of an isolated polynucleotide include recombinant polynucleotides maintained in heterologous host cells or purified (partially or substantially) polynucleotides in solution. An isolated polynucleotide includes a polynucleotide molecule contained in cells that ordinarily contain the polynucleotide molecule, but the polynucleotide molecule is present extrachromosomally or at a chromosomal location that is different from its natural chromosomal location. Isolated RNA molecules include in vivo or in vitro RNA transcripts of the present invention, as well as positive and negative strand forms, and double-stranded forms. Isolated polynucleotides or nucleic acids according to the present invention further include such molecules produced synthetically. In addition, a polynucleotide or a nucleic acid may be or may include a regulatory element such as a promoter, ribosome binding site, or a transcription terminator.

By a nucleic acid or polynucleotide having a nucleotide sequence at least, for example, 95% "identical" to a reference nucleotide sequence of the present invention, it is intended that the nucleotide sequence of the polynucleotide is identical to the reference sequence except that the polynucleotide sequence may include up to five point mutations per each 100 nucleotides of the reference nucleotide sequence. In other words, to obtain a polynucleotide having a nucleotide sequence at least 95% identical to a reference nucleotide sequence, up to 5% of the nucleotides in the reference sequence may be deleted or substituted with another nucleotide, or a number of nucleotides up to 5% of the total nucleotides in the reference sequence may be inserted into the reference sequence. These alterations of the reference sequence may occur at the 5' or 3' terminal positions of the reference nucleotide sequence or anywhere between those terminal positions, interspersed either individually among residues in the reference sequence or in one or more contiguous groups within the reference sequence. As a practical matter, whether any particular polynucleotide sequence is at least 80%, 85%, 90%, 95%, 96%, 97%, 98% or 99% identical to a nucleotide sequence of the present invention can be determined conventionally using known computer programs, such as the ones discussed above for polypeptides (e.g. ALIGN-2).

The term "expression cassette" refers to a polynucleotide generated recombinantly or synthetically, with a series of specified nucleic acid elements that permit transcription of a particular nucleic acid in a target cell. The recombinant expression cassette can be incorporated into a plasmid, chromosome, mitochondrial DNA, plastid DNA, virus, or nucleic acid fragment. Typically, the recombinant expression cassette portion of an expression vector includes, among other sequences, a nucleic acid sequence to be transcribed and a promoter. In certain embodiments, the expression cassette of the invention comprises polynucleotide sequences that encode bispecific antigen binding molecules of the invention or fragments thereof.

The term "vector" or "expression vector" is synonymous with "expression construct" and refers to a DNA molecule that is used to introduce and direct the expression of a specific gene to which it is operably associated in a target cell. The term includes the vector as a self-replicating nucleic acid structure as well as the vector incorporated into the genome of a host cell into which it has been introduced. The expression vector of the present invention comprises an expression cassette. Expression vectors allow transcription of large amounts of stable mRNA. Once the expression vector is inside the target cell, the ribonucleic acid molecule or protein that is encoded by the gene is produced by the cellular transcription and/or translation machinery. In one embodiment, the expression vector of the invention comprises an expression cassette that comprises polynucleotide sequences that encode bispecific antigen binding molecules of the invention or fragments thereof.

The terms "host cell". "host cell line." and "host cell culture" are used interchangeably and refer to cells into which exogenous nucleic acid has been introduced, including the progeny of such cells. Host cells include "transformants" and "transformed cells." which include the primary transformed cell and progeny derived therefrom without regard to the number of passages. Progeny may not be completely identical in nucleic acid content to a parent cell, but may contain mutations. Mutant progeny that have the same function or biological activity as screened or selected for in the originally transformed cell are included herein. A host cell is any type of cellular system that can be used to generate the bispecific antigen binding molecules of the present invention. Host cells include cultured cells, e.g. mammalian cultured cells, such as CHO cells, BHK cells, NS0 cells, SP2/0) cells, YO myeloma cells, P3X63 mouse myeloma cells, PER cells, PER.C6 cells or hybridoma cells, yeast cells, insect cells, and plant cells, to name only a few; but also cells comprised within a transgenic animal, transgenic plant or cultured plant or animal tissue.

An "effective amount" of an agent refers to the amount that is necessary to result in a physiological change in the cell or tissue to which it is administered.

A "therapeutically effective amount" of an agent, e.g. a pharmaceutical composition, refers to an amount effective, at dosages and for periods of time necessary, to achieve the desired therapeutic or prophylactic result. A therapeutically effective amount of an agent for example eliminates, decreases, delays, minimizes or prevents adverse effects of a disease.

An "individual" or "subject" is a mammal. Mammals include, but are not limited to, domesticated animals (e.g. cows, sheep, cats, dogs, and horses), primates (e.g. humans and non-human primates such as monkeys), rabbits, and rodents (e.g. mice and rats). Particularly, the individual or subject is a human.

The term "pharmaceutical composition" refers to a preparation which is in such form as to permit the biological activity of an active ingredient contained therein to be effective, and which contains no additional components which are unacceptably toxic to a subject to which the formulation would be administered.

A "pharmaceutically acceptable excipient" refers to an ingredient in a pharmaceutical composition, other than an active ingredient, which is nontoxic to a subject. A pharmaceutically acceptable excipient includes, but is not limited to, a buffer, a stabilizer, or a preservative.

The term "package insert" is used to refer to instructions customarily included in commercial packages of therapeutic products, that contain information about the indications, usage, dosage, administration, combination therapy, contraindications and/or warnings concerning the use of such therapeutic products.

As used herein, "treatment" (and grammatical variations thereof such as "treat" or "treating") refers to clinical intervention in an attempt to alter the natural course of the individual being treated, and can be performed either for prophylaxis or during the course of clinical pathology. Desirable effects of treatment include, but are not limited to, preventing occurrence or recurrence of disease, alleviation of symptoms, diminishment of any direct or indirect pathological consequences of the disease, preventing metastasis, decreasing the rate of disease progression, amelioration or palliation of the disease state, and remission or improved prognosis. In some embodiments, the molecules of the invention are used to delay development of a disease or to slow the progression of a disease.

The term "cancer" as used herein refers to proliferative diseases, such as lymphomas, lymphocytic leukemias, lung cancer, non-small cell lung (NSCL) cancer, bronchoalveolar cell lung cancer, bone cancer, pancreatic cancer, skin cancer, cancer of the head or neck, cutaneous or intraocular melanoma, uterine cancer, ovarian cancer, rectal cancer, cancer of the anal region, stomach cancer, gastric cancer, colon cancer, breast cancer, uterine cancer, carcinoma of the fallopian tubes, carcinoma of the endometrium, carcinoma of the cervix, carcinoma of the vagina, carcinoma of the vulva. Hodgkin's Disease, cancer of the esophagus, cancer of the small intestine, cancer of the endocrine system, cancer of the thyroid gland, cancer of the parathyroid gland, cancer of the adrenal gland, sarcoma of soft tissue, cancer of the urethra, cancer of the penis, prostate cancer, cancer of the bladder, cancer of the kidney or ureter, renal cell carcinoma, carcinoma of the renal pelvis, mesothelioma, hepatocellular cancer, biliary cancer, neoplasms of the central nervous system (CNS), spinal axis tumors, brain stem glioma, glioblastoma multiforme, astrocytomas, schwannomas, ependymomas, medulloblastomas, meningiomas, squamous cell carcinomas, pituitary adenoma and Ewing sarcoma, including refractory versions of any of the above cancers, or a combination of one or more of the above cancers.

The term "chemotherapeutic agent" as used herein refers to a chemical compound useful in the treatment of cancer. In one aspect, the chemotherapeutic agent is an antimetabolite. In one aspect, the antimetabolite is selected from the group consisting of Aminopterin, Methotrexate, Pemetrexed, Raltitrexed, Cladribine, Clofarabine, Fludarabine, Mercaptopurine, Pentostatin, Thioguanine, Capecitabine, Cytarabine, Fluorouracil, Floxuridine, and Gemcitabine, In one particular aspect, the antimetabolite is capecitabine or gemcitabine. In another aspect, the antimetabolite is fluorouracil. In one aspect, the chemotherapeutic agent is an agent that affects microtubule formation. In one aspect, the agent that affects microtubule formation is selected from the group consisting of: paclitaxel, docetaxel, vincristine, vinblastine, vindesine, vinorelbin, taxotere, etoposide, and teniposide. In another aspect, the chemotherapeutic agent is an alkylating agent such as cyclophosphamide. In one aspect, the chemotherapeutic agent is a cytotoxic antibiotic such as a topoisomerase II inhibitor. In one aspect, the topoisomerase II inhibitor is doxorubicin.

Bispecific Antibodies of the Invention

The invention provides novel bispecific antigen binding molecules with particularly advantageous properties such as producibility, stability, binding affinity, biological activity, targeting efficiency, reduced toxicity, an extended dosage range that can be given to a patient and thereby a possibly enhanced efficacy.

Exemplary Bispecific Antigen Binding Molecules

In one aspect, the invention provides bispecific antigen binding molecules, comprising
  (a) at least one antigen binding domain capable of specific binding to CD40, and
  (b) at least one antigen binding domain capable of specific binding to a target cell antigen, and
  (c) a Fc region composed of a first and a second subunit capable of stable association.

In a particular aspect, these bispecific antigen binding molecules are characterized by targeted agonistic binding to CD40. In particular, the bispecific antigen binding molecule is a CD40 agonist that is targeted against a tumor associated target cell antigen. In another particular aspect, the bispecific antigen binding molecules of the invention comprise a Fc region composed of a first and a second subunit capable of stable association which comprises mutations that reduce effector function. The use of a Fc region comprising mutations that reduce or abolish effector function will prevent unspecific agonism by crosslinking via Fc receptors and will prevent ADCC of CD40$^+$ cells.

The bispecific antigen binding molecules as described herein possess the advantage over conventional antibodies capable of specific binding to CD40 in that they selectively induce immune response at the target cells, which are typically cancer cells or tumor stroma. In one aspect, the tumor-associated target cell antigen is selected from the group consisting of Fibroblast Activation Protein (FAP), Melanoma-associated Chondroitin Sulfate Proteoglycan (MCSP), Epidermal Growth Factor Receptor (EGFR), Carcinoembryonic Antigen (CEA), CD19, CD20 and CD33.

In a particular aspect, the tumor-associated target cell antigen is FAP.

These bispecific antigen binding molecules are characterized by FAP-targeted agonistic binding to CD40. In the presence of FAP-expressing cells the bispecific antigen binding molecules are able to activate antigen presenting cells (APCs. Example 2.1), to activate human B cells (Examples 2.1.1 and 2.1.3), human Daudi cells (Example 2.1.2) and human monocyte-derived dendritic cells (moDCs, Example 2.1.4)

In one aspect, provided is a bispecific antigen binding molecule, wherein the antigen binding domain capable of specific binding to CD40 comprises a heavy chain variable region (V$_H$CD40) comprising (i) CDR-H1 comprising the amino acid sequence of SEQ ID NO: 19, (ii) CDR-H2 comprising the amino acid sequence of SEQ ID NO:20, and (iii) CDR-H3 comprising the amino acid sequence of SEQ ID NO:21, and a light chain variable region (V$_L$CD40) comprising (iv) CDR-L1 comprising the amino acid sequence of SEQ ID NO:22, (v) CDR-L2 comprising the amino acid sequence of SEQ ID NO:23, and (vi) CDR-L3 comprising the amino acid sequence of SEQ ID NO:24.

In another aspect, provided is a bispecific antigen binding molecule, wherein the antigen binding domain capable of specific binding to CD40 comprises a heavy chain variable region (V$_H$CD40) comprising (i) CDR-H1 comprising the amino acid sequence of SEQ ID NO:27, (ii) CDR-H2 comprising the amino acid sequence of SEQ ID NO:28, and (iii) CDR-H3 comprising the amino acid sequence of SEQ ID NO:29, and a light chain variable region (V$_L$CD40)

comprising (iv) CDR-L1 comprising the amino acid sequence of SEQ ID NO:30, (v) CDR-L2 comprising the amino acid sequence of SEQ ID NO:31, and (vi) CDR-L3 comprising the amino acid sequence of SEQ ID NO:32.

In one aspect, the bispecific antigen binding molecule comprises an antigen binding domain capable of specific binding to CD40 and comprises a comprises a heavy chain variable region ($V_H$CD40) comprising the amino acid sequence of SEQ ID NO:25 and a light chain variable region ($V_L$CD40) comprising the amino acid sequence of SEQ ID NO:26.

In another aspect, the bispecific antigen binding molecule comprises an antigen binding domain capable of specific binding to CD40 and comprises a comprises a heavy chain variable region ($V_H$CD40) comprising the amino acid sequence of SEQ ID NO:33 and a light chain variable region ($V_L$CD40) comprising the amino acid sequence of SEQ ID NO:34.

In another aspect, provided is a bispecific antigen binding molecule, wherein the antigen binding domain capable of specific binding to CD40 comprises
  (i) a heavy chain variable region ($V_H$CD40) comprising an amino acid sequence selected from the group consisting of SEQ ID NO:45, SEQ ID NO:46, SEQ ID NO:47, SEQ ID NO:48. SEQ ID NO:49, SEQ ID NO:50, SEQ ID NO:51, SEQ ID NO:52, SEQ ID NO:53, SEQ ID NO: 54 and SEQ ID NO:55, and
  (ii) a light chain variable region ($V_L$CD40) comprising the amino acid sequence selected from the group consisting of SEQ ID NO:56, SEQ ID NO:57, SEQ ID NO:58, SEQ ID NO:59. SEQ ID NO:60, SEQ ID NO:61, SEQ ID NO: 62, SEQ ID NO: 63 and SEQ ID NO:64.

In one aspect, provided is a bispecific antigen binding molecule, wherein the antigen binding domain capable of specific binding to CD40 comprises a heavy chain variable region ($V_H$CD40) comprising the amino acid sequence of SEQ ID NO:47 and a light chain variable region ($V_L$CD40) comprising the amino acid sequence of SEQ ID NO:57.

In a further aspect, provided is a bispecific antigen binding molecule, wherein the antigen binding domain capable of specific binding to CD40 comprises
  (i) a heavy chain variable region ($V_H$CD40) comprising an amino acid sequence selected from the group consisting of SEQ ID NO: 171, SEQ ID NO: 172, SEQ ID NO: 173 and SEQ ID NO: 174, and
  (ii) a light chain variable region ($V_L$CD40) comprising the amino acid sequence selected from the group consisting of SEQ ID NO: 175, SEQ ID NO: 176, SEQ ID NO: 177, and SEQ ID NO: 178.

In one aspect, provided is a bispecific antigen binding molecule, wherein the antigen binding domain capable of specific binding to CD40 comprises
  (a) a VH comprising the amino acid sequence of SEQ ID NO: 171 and a VL comprising the amino acid sequence of SEQ ID NO: 175, or
  (b) a VH comprising the amino acid sequence of SEQ ID NO: 173 and a VL comprising the amino acid sequence of SEQ ID NO: 177, or
  (c) a VH comprising the amino acid sequence of SEQ ID NO: 174 and a VL comprising the amino acid sequence of SEQ ID NO: 178, or
  (d) a VH comprising the amino acid sequence of SEQ ID NO: 171 and a VL comprising the amino acid sequence of SEQ ID NO: 177, or
  (e) a VH comprising the amino acid sequence of SEQ ID NO: 171 and a VL comprising the amino acid sequence of SEQ ID NO:178, or
  (f) a VH comprising the amino acid sequence of SEQ ID NO: 173 and a VL comprising the amino acid sequence of SEQ ID NO: 175, or
  (g) a VH comprising the amino acid sequence of SEQ ID NO:173 and a VL comprising the amino acid sequence of SEQ ID NO:178, or
  (h) a VH comprising the amino acid sequence of SEQ ID NO: 174 and a VL comprising the amino acid sequence of SEQ ID NO: 175, or
  (i) a VH comprising the amino acid sequence of SEQ ID NO: 174 and a VL comprising the amino acid sequence of SEQ ID NO: 177, or
  (j) a VH comprising the amino acid sequence of SEQ ID NO: 171 and a VL comprising the amino acid sequence of SEQ ID NO: 176, or
  (k) a VH comprising the amino acid sequence of SEQ ID NO:172 and a VL comprising the amino acid sequence of SEQ ID NO: 175, or
  (l) a VH comprising the amino acid sequence of SEQ ID NO: 172 and a VL comprising the amino acid sequence of SEQ ID NO: 176, or
  (m) a VH comprising the amino acid sequence of SEQ ID NO: 172 and a VL comprising the amino acid sequence of SEQ ID NO: 177, or
  (n) a VH comprising the amino acid sequence of SEQ ID NO: 172 and a VL comprising the amino acid sequence of SEQ ID NO:178, or
  (o) a VH comprising the amino acid sequence of SEQ ID NO:173 and a VL comprising the amino acid sequence of SEQ ID NO:176, or
  (p) a VH comprising the amino acid sequence of SEQ ID NO:174 and a VL comprising the amino acid sequence of SEQ ID NO:176.

In a particular aspect, provided is a bispecific antigen binding molecule, wherein the antigen binding domain capable of specific binding to CD40 comprises a VH comprising the amino acid sequence of SEQ ID NO: 171 and a VL comprising the amino acid sequence of SEQ ID NO: 175.

In yet another aspect, provided is a bispecific antigen binding molecule, wherein the antigen binding domain capable of specific binding to CD40 comprises
  (i) a heavy chain variable region ($V_H$CD40) comprising an amino acid sequence selected from the group consisting of SEQ ID NO: 179, SEQ ID NO: 180, SEQ ID NO: 181, SEQ ID NO: 182, SEQ ID NO:183 and SEQ ID NO: 184, and
  (ii) a light chain variable region ($V_L$CD40) comprising the amino acid sequence selected from the group consisting of SEQ ID NO: 185, SEQ ID NO: 186, SEQ ID NO: 187, and SEQ ID NO: 188.

In one aspect, provided is a bispecific antigen binding molecule, wherein the antigen binding domain capable of specific binding to CD40 comprises
  (a) a VH comprising the amino acid sequence of SEQ ID NO: 179 and a VL comprising the amino acid sequence of SEQ ID NO:185, or
  (b) a VH comprising the amino acid sequence of SEQ ID NO: 180 and a VL comprising the amino acid sequence of SEQ ID NO: 185, or
  (c) a VH comprising the amino acid sequence of SEQ ID NO: 181 and a VL comprising the amino acid sequence of SEQ ID NO: 185, or
  (d) a VH comprising the amino acid sequence of SEQ ID NO: 182 and a VL comprising the amino acid sequence of SEQ ID NO: 185, or (e) a VH comprising the amino acid sequence of SEQ ID NO: 179 and a VL comprising the amino acid sequence of SEQ ID NO: 186, or
(f) a VH comprising the amino acid sequence of SEQ ID NO: 180 and a VL comprising the amino acid sequence of SEQ ID NO:186, or
(g) a VH comprising the amino acid sequence of SEQ ID NO:181 and a VL comprising the amino acid sequence of SEQ ID NO: 186, or
(h) a VH comprising the amino acid sequence of SEQ ID NO: 182 and a VL comprising the amino acid sequence of SEQ ID NO:186, or
(i) a VH comprising the amino acid sequence of SEQ ID NO: 183 and a VL comprising the amino acid sequence of SEQ ID NO: 187, or
(j) a VH comprising the amino acid sequence of SEQ ID NO: 183 and a VL comprising the amino acid sequence of SEQ ID NO: 188, or
(k) a VH comprising the amino acid sequence of SEQ ID NO:184 and a VL comprising the amino acid sequence of SEQ ID NO: 187, or
(l) a VH comprising the amino acid sequence of SEQ ID NO: 184 and a VL comprising the amino acid sequence of SEQ ID NO:188.

In a particular aspect, provided is a bispecific antigen binding molecule, wherein the antigen binding domain capable of specific binding to CD40 comprises a VH comprising the amino acid sequence of SEQ ID NO: 179 and a VL comprising the amino acid sequence of SEQ ID NO: 185 or wherein the antigen binding domain capable of specific binding to CD40 comprises a VH comprising the amino acid sequence of SEQ ID NO: 182 and a VL comprising the amino acid sequence of SEQ ID NO: 185.

Bispecific Antigen Binding Molecules Wherein the Target Cell Antigen is FAP

In a particular aspect, the target cell antigen is Fibroblast Activation Protein (FAP). FAP binding moieties have been described in WO 2012/02006 which is included by reference in its entirety. FAP binding moieties of particular interest are described below.

In one aspect, the invention provides a bispecific antigen binding molecule, wherein the antigen binding domain capable of specific binding to FAP binds to a polypeptide comprising, or consisting of, the amino acid sequence of SEQ ID NO:2.

In another aspect, the invention provides a bispecific antigen binding molecule, wherein the antigen binding domain capable of specific binding to Fibroblast Activation Protein (FAP) comprises
(a) a heavy chain variable region ($V_H$FAP) comprising (i) CDR-H1 comprising the amino acid sequence of SEQ ID NO:3, (ii) CDR-H2 comprising the amino acid sequence of SEQ ID NO:4, and (iii) CDR-H3 comprising the amino acid sequence of SEQ ID NO:5, and a light chain variable region ($V_L$FAP) comprising (iv) CDR-L1 comprising the amino acid sequence of SEQ ID NO: 6, (v) CDR-L2 comprising the amino acid sequence of SEQ ID NO:7, and (vi) CDR-L3 comprising the amino acid sequence of SEQ ID NO:8, or
(b) a heavy chain variable region ($V_H$FAP) comprising (i) CDR-H1 comprising the amino acid sequence of SEQ ID NO: 11, (ii) CDR-H2 comprising the amino acid sequence of SEQ ID NO: 12, and (iii) CDR-H3 comprising the amino acid sequence of SEQ ID NO: 13, and a light chain variable region ($V_L$FAP) comprising (iv) CDR-L1 comprising the amino acid sequence of SEQ ID NO: 14, (v) CDR-L2 comprising the amino acid sequence of SEQ ID NO: 15, and (vi) CDR-L3 comprising the amino acid sequence of SEQ ID NO: 16.

In particular, provided is a bispecific antigen binding molecule, wherein the heavy chain variable region ($V_H$FAP) comprising (i) CDR-H1 comprising the amino acid sequence of SEQ ID NO: 3, (ii) CDR-H2 comprising the amino acid sequence of SEQ ID NO:4, and (iii) CDR-H3 comprising the amino acid sequence of SEQ ID NO:5, and the light chain variable region ($V_L$FAP) comprising (iv) CDR-L1 comprising the amino acid sequence of SEQ ID NO:6, (v) CDR-L2 comprising the amino acid sequence of SEQ ID NO: 7, and (vi) CDR-L3 comprising the amino acid sequence of SEQ ID NO:8. In another aspect, the antigen binding domain capable of specific binding to FAP comprises a heavy chain variable region ($V_H$FAP) comprising (i) CDR-H1 comprising the amino acid sequence of SEQ ID NO: 11, (ii) CDR-H2 comprising the amino acid sequence of SEQ ID NO: 12, and (iii) CDR-H3 comprising the amino acid sequence of SEQ ID NO: 13, and a light chain variable region ($V_L$FAP) comprising (iv) CDR-L1 comprising the amino acid sequence of SEQ ID NO:14, (v) CDR-L2 comprising the amino acid sequence of SEQ ID NO: 15, and (vi) CDR-L3 comprising the amino acid sequence of SEQ ID NO: 16.

In a further aspect, provided is a bispecific antigen binding molecule, wherein the antigen binding domain capable of specific binding to FAP comprises (a) a heavy chain variable region ($V_H$FAP) comprising an amino acid sequence that is at least about 95%, 96%, 97%, 98%, 99% or 100% identical to the amino acid sequence of SEQ ID NO:9, and a light chain variable region ($V_L$FAP) comprising an amino acid sequence that is at least about 95%, 96%, 97%, 98%, 99% or 100% identical to the amino acid sequence of SEQ ID NO: 10, or (b) a heavy chain variable region ($V_H$FAP) comprising an amino acid sequence that is at least about 95%, 96%, 97%, 98%. 99% or 100% identical to the amino acid sequence of SEQ ID NO: 17, and a light chain variable region ($V_L$FAP) comprising an amino acid sequence that is at least about 95%, 96%, 97%, 98%. 99% or 100% identical to the amino acid sequence of SEQ ID NO:18.

In one aspect, the antigen binding domain capable of specific binding to FAP comprises a heavy chain variable region VH comprising the amino acid sequence of SEQ ID NO: 9 and a light chain variable region comprising an amino acid sequence of SEQ ID NO: 10 or the antigen binding domain capable of specific binding to FAP comprises a heavy chain variable region VH comprising an amino acid sequence of SEQ ID NO: 17 and a light chain variable region comprising an amino acid sequence of SEQ ID NO: 18.

Bispecific Antigen Binding Molecules Binding to CD40 and FAP

In another aspect, provided is a bispecific antigen binding molecule, comprising
(i) at least one antigen binding domain capable of specific binding to CD40, comprising a heavy chain variable region ($V_H$CD40) comprising an amino acid sequence selected from the group consisting of SEQ ID NO:25, SEQ ID NO:45, SEQ ID NO:46, SEQ ID NO:47, SEQ ID NO: 48, SEQ ID NO:49, SEQ ID NO:50, SEQ ID NO:51, SEQ ID NO:52, SEQ ID NO:53, SEQ ID NO: 54 and SEQ ID NO:55, and a light chain variable region ($V_L$CD40) comprising an amino acid sequence selected from the group consisting of SEQ ID NO:26, SEQ ID NO:56, SEQ ID NO: 57, SEQ ID NO:58, SEQ ID NO:59, SEQ ID NO: 60, SEQ ID NO:61, SEQ ID NO: 62, SEQ ID NO: 63 and SEQ ID NO:64, and
(ii) at least one antigen binding domain capable of specific binding to FAP, comprising a heavy chain variable region ($V_H$FAP) comprising an amino acid sequence of SEQ ID NO:9 and a light chain variable region ($V_L$FAP) comprising an amino acid sequence of SEQ ID NO:10, or a heavy chain variable region ($V_H$FAP) comprising an amino acid sequence of SEQ ID NO: 17 and a light chain variable region ($V_L$FAP) comprising an amino acid sequence of SEQ ID NO:18.

In a further aspect, provided is a bispecific antigen binding molecule, comprising
(i) at least one antigen binding domain capable of specific binding to CD40, comprising a heavy chain variable region ($V_H$CD40) comprising an amino acid sequence selected from the group consisting of SEQ ID NO:171, SEQ ID NO:172, SEQ ID NO: 173, SEQ ID NO: 174, SEQ ID NO: 179, SEQ ID NO: 180, SEQ ID NO: 181, SEQ ID NO: 182, SEQ ID NO: 183 and SEQ ID NO: 184, and a light chain variable region ($V_L$CD40) comprising an amino acid sequence selected from the group consisting of SEQ ID NO:175, SEQ ID NO: 176, SEQ ID NO: 177, SEQ ID NO: 178, SEQ ID NO:185, SEQ ID NO:186, SEQ ID NO: 187 and SEQ ID NO: 188, and
(ii) at least one antigen binding domain capable of specific binding to FAP, comprising a heavy chain variable region ($V_H$FAP) comprising an amino acid sequence of SEQ ID NO:9 and a light chain variable region ($V_L$FAP) comprising an amino acid sequence of SEQ ID NO:10, or a heavy chain variable region ($V_H$FAP) comprising an amino acid sequence of SEQ ID NO: 17 and a light chain variable region ($V_L$FAP) comprising an amino acid sequence of SEQ ID NO:18.

In a particular aspect, provided is a bispecific antigen binding molecule, comprising
(i) at least one antigen binding domain capable of specific binding to CD40, comprising a heavy chain variable region ($V_H$CD40) comprising an amino acid sequence of SEQ ID NO:171 and a light chain variable region ($V_L$CD40) comprising an amino acid sequence of SEQ ID NO: 175, and
(ii) at least one antigen binding domain capable of specific binding to FAP, comprising a heavy chain variable region ($V_H$FAP) comprising an amino acid sequence of SEQ ID NO:9 and a light chain variable region ($V_L$FAP) comprising an amino acid sequence of SEQ ID NO:10, or a heavy chain variable region ($V_H$FAP) comprising an amino acid sequence of SEQ ID NO: 17 and a light chain variable region ($V_L$FAP) comprising an amino acid sequence of SEQ ID NO:18.

In another particular aspect, provided is a bispecific antigen binding molecule, comprising
(i) at least one antigen binding domain capable of specific binding to CD40, comprising a heavy chain variable region ($V_H$CD40) comprising an amino acid of SEQ ID NO: 179 or SEQ ID NO: 182 and a light chain variable region ($V_L$CD40) comprising an amino acid sequence of SEQ ID NO: 185, and
(ii) at least one antigen binding domain capable of specific binding to FAP, comprising a heavy chain variable region ($V_H$FAP) comprising an amino acid sequence of SEQ ID NO:9 and a light chain variable region ($V_L$FAP) comprising an amino acid sequence of SEQ ID NO:10, or a heavy chain variable region ($V_H$FAP) comprising an amino acid sequence of SEQ ID NO: 17 and a light chain variable region ($V_L$FAP) comprising an amino acid sequence of SEQ ID NO:18.

In a further aspect, provided is a bispecific antigen binding molecule, wherein
(i) the antigen binding domain capable of specific binding to CD40 comprises a heavy chain variable region ($V_H$CD40) comprising the amino acid sequence of SEQ ID NO: 25 and a light chain variable region ($V_L$CD40) comprising an amino acid sequence of SEQ ID NO: 26 and
(ii) the antigen binding domain capable of specific binding to FAP comprises a heavy chain variable region VH comprising an amino acid sequence of SEQ ID NO:9 and a light chain variable region comprising an amino acid sequence of SEQ ID NO: 10.

Furthermore, provided is a bispecific antigen binding molecule, wherein
(i) the antigen binding domain capable of specific binding to CD40 comprises a heavy chain variable region ($V_H$CD40) comprising the amino acid sequence of SEQ ID NO: 25 and a light chain variable region ($V_L$CD40) comprising an amino acid sequence of SEQ ID NO: 26 and
(ii) the antigen binding domain capable of specific binding to FAP comprises a heavy chain variable region VH comprising an amino acid sequence of SEQ ID NO: 17 and a light chain variable region comprising an amino acid sequence of SEQ ID NO: 18.

In another aspect, provided is a bispecific antigen binding molecule, wherein
(i) the antigen binding domain capable of specific binding to CD40 comprises a heavy chain variable region ($V_H$CD40) comprising the amino acid sequence of SEQ ID NO: 47 and a light chain variable region ($V_L$CD40) comprising an amino acid sequence of SEQ ID NO: 57 and
(ii) the antigen binding domain capable of specific binding to FAP comprises a heavy chain variable region VH comprising an amino acid sequence of SEQ ID NO: 17 and a light chain variable region comprising an amino acid sequence of SEQ ID NO: 18.

In another aspect, provided is a bispecific antigen binding molecule, wherein
(i) the antigen binding domain capable of specific binding to CD40 comprises a heavy chain variable region ($V_H$CD40) comprising an amino acid sequence selected from the group consisting of SEQ ID NO: 171, SEQ ID NO: 172, SEQ ID NO: 173, SEQ ID NO: 174, SEQ ID NO: 179, SEQ ID NO: 180, SEQ ID NO: 181, SEQ ID NO: 182, SEQ ID NO: 183 and SEQ ID NO: 184, and a light chain variable region ($V_L$CD40) comprising an amino acid sequence selected from the group consisting of SEQ ID NO: 175, SEQ ID NO: 176, SEQ ID NO:177, SEQ ID NO: 178, SEQ ID NO: 185, SEQ ID NO: 186, SEQ ID NO: 187 and SEQ ID NO: 188, and
(ii) the antigen binding domain capable of specific binding to FAP comprises a heavy chain variable region VH comprising an amino acid sequence of SEQ ID NO: 17 and a light chain variable region comprising an amino acid sequence of SEQ ID NO: 18.

Bispecific, Monovalent Antigen Binding Molecules (1+1 Format)

In one aspect, the invention relates to bispecific antigen binding molecules comprising (a) one antigen binding domain capable of specific binding to a CD40, (b) one antigen binding domain capable of specific binding to a target cell antigen, and (c) a Fc domain composed of a first and a second subunit capable of stable association.

In a particular aspect, provided is a bispecific antigen binding molecule, wherein said molecule comprises (a) a first Fab fragment capable of specific binding to CD40, (b) a second Fab fragment capable of specific binding to a target cell antigen, and (c) a Fc domain composed of a first and a second subunit capable of stable association. In one aspect, the target cell antigen is FAP.

In one aspect, provided is a bispecific antigen binding molecule, wherein said molecule comprises
(i) a first Fab fragment capable of specific binding to CD40, comprising a heavy chain variable region ($V_H$CD40) comprising an amino acid sequence selected from the group consisting of SEQ ID NO: 25, SEQ ID NO:45, SEQ ID NO:46, SEQ ID NO:47, SEQ ID NO:48, SEQ ID NO:49, SEQ ID NO:50, SEQ ID NO:51, SEQ ID NO:52, SEQ ID NO:53, SEQ ID NO:54 and SEQ ID NO: 55, and a light chain variable region ($V_L$CD40) comprising an amino acid sequence selected from the group consisting of SEQ ID NO:26, SEQ ID NO:56, SEQ ID NO:57, SEQ ID NO:58, SEQ ID NO:59, SEQ ID NO:60, SEQ ID NO:61, SEQ ID NO:62, SEQ ID NO:63 and SEQ ID NO: 64, and
(ii) a second Fab fragment capable of specific binding to FAP, comprising a heavy chain variable region ($V_H$FAP) comprising an amino acid sequence of SEQ ID NO:9 and a light chain variable region ($V_L$FAP) comprising an amino acid sequence of SEQ ID NO: 10, or a heavy chain variable region ($V_H$FAP) comprising an amino acid sequence of SEQ ID NO: 17 and a light chain variable region ($V_L$FAP) comprising an amino acid sequence of SEQ ID NO:18.

In one aspect, provided is a bispecific antigen binding molecule comprising a first heavy chain (HC1) comprising the amino acid sequence of SEQ ID NO: 141, a second heavy chain (HC2) comprising the amino acid sequence of SEQ ID NO: 140, a first light chain comprising the amino acid sequence of SEQ ID NO:138 and a second light chain comprising the amino acid sequence of SEQ ID NO: 137.

In another aspect, provided is a bispecific antigen binding molecule, wherein said molecule comprises
(i) a first Fab fragment capable of specific binding to CD40, comprising a heavy chain variable region ($V_H$CD40) comprising an amino acid sequence selected from the group consisting of SEQ ID NO: 25, SEQ ID NO:33, SEQ ID NO: 171, SEQ ID NO: 172, SEQ ID NO: 173, SEQ ID NO: 174, SEQ ID NO: 179, SEQ ID NO: 180, SEQ ID NO: 181, SEQ ID NO: 182, SEQ ID NO: 183 and SEQ ID NO:184, and a light chain variable region ($V_L$CD40) comprising an amino acid sequence selected from the group consisting of SEQ ID NO:26, SEQ ID NO:34, SEQ ID NO: 175, SEQ ID NO: 176, SEQ ID NO: 177, SEQ ID NO: 178, SEQ ID NO: 185, SEQ ID NO: 186, SEQ ID NO: 187 and SEQ ID NO: 188, and
(ii) a second Fab fragment capable of specific binding to FAP, comprising a heavy chain variable region ($V_H$FAP) comprising an amino acid sequence of SEQ ID NO:9 and a light chain variable region ($V_L$FAP) comprising an amino acid sequence of SEQ ID NO:10, or a heavy chain variable region ($V_H$FAP) comprising an amino acid sequence of SEQ ID NO: 17 and a light chain variable region ($V_L$FAP) comprising an amino acid sequence of SEQ ID NO:18.

In one particular aspect, provided is a bispecific antigen binding molecule, wherein said molecule comprises
(i) a first Fab fragment capable of specific binding to CD40, comprising a heavy chain variable region ($V_H$CD40) comprising an amino acid sequence selected from the group consisting of SEQ ID NO: 171, SEQ ID NO: 172, SEQ ID NO: 173, SEQ ID NO: 174, SEQ ID NO: 179, SEQ ID NO: 180, SEQ ID NO:181, SEQ ID NO: 182, SEQ ID NO: 183 and SEQ ID NO: 184, and a light chain variable region ($V_L$CD40) comprising an amino acid sequence selected from the group consisting of SEQ ID NO: 175, SEQ ID NO: 176, SEQ ID NO: 177, SEQ ID NO: 178, SEQ ID NO: 185, SEQ ID NO: 186, SEQ ID NO: 187 and SEQ ID NO: 188, and
(ii) a second Fab fragment capable of specific binding to FAP, comprising a heavy chain variable region ($V_H$FAP) comprising an amino acid sequence of SEQ ID NO:9 and a light chain variable region ($V_L$FAP) comprising an amino acid sequence of SEQ ID NO: 10, or a heavy chain variable region ($V_H$FAP) comprising an amino acid sequence of SEQ ID NO: 17 and a light chain variable region ($V_L$FAP) comprising an amino acid sequence of SEQ ID NO: 18.

In a particular aspect, provided is a bispecific antigen binding molecule, wherein said molecule comprises (i) a first Fab fragment capable of specific binding to CD40, comprising a heavy chain variable region ($V_H$CD40) comprising an amino acid sequence of SEQ ID NO: 171 and a light chain variable region ($V_L$CD40) comprising an amino acid sequence of SEQ ID NO: 175, and (ii) a second Fab fragment capable of specific binding to FAP, comprising a heavy chain variable region ($V_H$FAP) comprising an amino acid sequence of SEQ ID NO: 17 and a light chain variable region ($V_L$FAP) comprising an amino acid sequence of SEQ ID NO:18.

In another particular aspect, provided is a bispecific antigen binding molecule, wherein said molecule comprises (i) a first Fab fragment capable of specific binding to CD40, comprising a heavy chain variable region ($V_H$CD40) comprising an amino acid sequence of SEQ ID NO: 179 or SEQ ID NO: 182, and a light chain variable region ($V_L$CD40) comprising an amino acid sequence of SEQ ID NO: 185, and (ii) a second Fab fragment capable of specific binding to FAP, comprising a heavy chain variable region ($V_H$FAP) comprising an amino acid sequence of SEQ ID NO: 17 and a light chain variable region ($V_L$FAP) comprising an amino acid sequence of SEQ ID NO: 18.

In a particular aspect, provided is a bispecific antigen binding molecule comprising a first heavy chain (HC1) comprising the amino acid sequence of SEQ ID NO: 163, a second heavy chain (HC2) comprising the amino acid sequence of SEQ ID NO: 164, a first light chain comprising the amino acid sequence of SEQ ID NO: 165 and a second light chain comprising the amino acid sequence of SEQ ID NO: 162.

Bispecific Antigen Binding Molecules Bivalent for Binding to CD40 and Monovalent for Binding to the Target Cell Antigen (2+1 Format)

In another aspect, the invention provides a bispecific antigen binding molecule comprising
(a) two antigen binding domains capable of specific binding to CD40,
(b) one antigen binding domain capable of specific binding to the target cell antigen, and
(c) a Fc domain composed of a first and a second subunit capable of stable association.

Thus, provided is a bispecific antigen binding molecule, wherein the bispecific antigen binding molecule is bivalent for CD40 and monovalent for the target cell antigen.

In one aspect, the bispecific antigen binding molecule comprises
- (a) two light chains and two heavy chains of an antibody comprising two Fab fragments capable of specific binding to CD40 and the Fc domain, and
- (b) a VH and VL domain capable of specific binding to a target cell antigen, wherein the VH domain and the VL domain are each connected via a peptide linker to one of the C-termini of the two heavy chains.

In a particular aspect, the peptide linker comprises an amino acid sequence selected from SEQ ID NO: 147, SEQ ID NO: 148, SEQ ID NO:152 and SEQ ID NO:153. More particularly, the peptide linker comprises the SEQ ID NO: 153.

In a particular aspect, the bispecific antigen binding molecule comprises
- (a) two light chains and two heavy chains of an antibody comprising two Fab fragments capable of specific binding to CD40 and the Fc domain, and
- (b) a VH and VL domain capable of specific binding to a target cell antigen, wherein the VH domain is connected via a peptide linker to the C-terminus of one of the heavy chains and wherein the VL domain is connected via a peptide linker to the C-terminus of the second heavy chain.

In another particular aspect, the bispecific antigen binding molecule comprises
- (a) two light chains and two heavy chains of an antibody comprising two Fab fragments capable of specific binding to CD40 and the Fc domain, and
- (b) a VH and VL domain capable of specific binding to a target cell antigen, wherein the VH domain is connected via a peptide linker to the C-terminus of the Fc knob heavy chain and wherein the VL domain is connected via a peptide linker to the C-terminus of the Fc hole heavy chain.

In one aspect, the bispecific antigen binding molecule comprises
- (a) two light chains and two heavy chains of an antibody comprising two Fab fragments capable of specific binding to CD40 and the Fc domain, and
- (b) a VH and VL domain capable of specific binding to a target cell antigen, wherein the VL domain is connected via a peptide linker to the C-terminus of the Fc knob heavy chain and wherein the VH domain is connected via a peptide linker to the C-terminus of the Fc hole heavy chain.

In one aspect, the invention relates to a bispecific antigen binding molecule, comprising
- (a) two Fab fragments capable of specific binding to CD40 connected to a Fc region, and
- (b) one antigen binding domain capable of specific binding to FAP connected to the C-terminus of the Fc region.

In a particular aspect, the invention provides a bispecific antigen binding molecule comprising
- (a) two light chains and two heavy chains of an antibody comprising two Fab fragments capable of specific binding to CD40, and a Fc region, and
- (b) a VH and a VL of an antigen binding domain capable specific binding to FAP, wherein the VH is connected to the C-terminus of one of the two heavy chains of (a), and wherein the VL is connected to the C-terminus of the other of the two heavy chains of (a).

In another aspect, the invention relates to a bispecific antigen binding molecule, comprising
- (a) two heavy chains, each heavy chain comprising a VH and CH1 domain of a Fab fragment capable of specific binding to CD40 and a Fc region subunit,
- (b) two light chains, each light chain comprising a VL and CL domain of a Fab fragment capable of specific binding to CD40, and
- (c) a VH and a VL of an antigen binding domain capable of specific binding to FAP, wherein the VH is connected to the C-terminus of one of the two heavy chains of (a), and wherein the VL is connected to the C-terminus of the other of the two heavy chains of (a)

In particular, the VH domain is a heavy chain variable region ($V_H$FAP) comprising an amino acid sequence of SEQ ID NO:9 or of SEQ ID NO:17 and the VL domain is a light chain variable region ($V_L$FAP) comprising an amino acid sequence of SEQ ID NO: 10 or of SEQ ID NO: 18. More particularly, the VH domain is a heavy chain variable region ($V_H$FAP) comprising an amino acid sequence of SEQ ID NO: 17 and the VL domain is a light chain variable region ($V_L$FAP) comprising an amino acid sequence of SEQ ID NO:18.

In a particular aspect, the invention provides a bispecific antigen binding molecule comprising
- (a) two light chains, each comprising the amino acid sequence of SEQ ID NO:82, a first heavy chain comprising the amino acid sequence of SEQ ID NO:88, and a second heavy chain comprising the amino acid sequence of SEQ ID NO:89, or
- (b) two light chains, each comprising the amino acid sequence of SEQ ID NO: 133, a first heavy chain comprising the amino acid sequence of SEQ ID NO: 134, and a second heavy chain comprising the amino acid sequence of SEQ ID NO: 135.

In another particular aspect, the bispecific antigen binding molecule comprises
- (a) two light chains and two heavy chains of an antibody comprising two Fab fragments capable of specific binding to CD40 and the Fc domain, and
- (b) a Fab fragment capable of specific binding to a target cell antigen, wherein the Fab fragment is connected via a peptide linker to the C-terminus of one of the heavy chains.

In one aspect, provided is a bispecific antigen binding molecule, wherein the bispecific antigen binding molecule comprises
- (a) two heavy chains, each heavy chain comprising a VH and CH1 domain of a Fab fragment capable of specific binding to CD40, and a Fc region subunit,
- (b) two light chains, each light chain comprising a VL and CL domain of a Fab fragment capable of specific binding to CD40, and
- (c) one Fab fragment capable of specific binding to FAP, wherein the Fab fragment is connected to the C-terminus of one of the two heavy chains of (a).

In particular, the Fab fragment capable of specific binding is a crossover fab fragment.

In one aspect, the invention provides a bispecific antigen binding molecule comprising two light chains, each comprising the amino acid sequence of SEQ ID NO: 137, one light chain comprising the amino acid sequence of SEQ ID NO: 138, a first heavy chain comprising the amino acid sequence of SEQ ID NO: 139, and a second heavy chain comprising the amino acid sequence of SEQ ID NO: 136.

In a further aspect, provided is a bispecific antigen binding molecule, comprising (a) two heavy chains, each heavy chain comprising a VH and CH1 domain of a Fab fragment capable of specific binding to CD40 and a Fc region subunit,
(b) two light chains, each light chain comprising a VL and CL domain of a Fab fragment capable of specific binding to CD40, and
(c) a crossover fab fragment capable of specific binding to FAP comprising a VL-CH1 chain and a VH-CL chain, wherein the VH-CL chain is connected to the C-terminus of one of the two heavy chains of (a).

In one aspect, the VH-CL chain is connected to the C-terminus of the FC knob heavy chain.

In another aspect, provided is a bispecific antigen binding molecule, comprising
(a) two heavy chains, each heavy chain comprising a VH and CH1 domain of a Fab fragment capable of specific binding to CD40 and a Fc region subunit,
(b) two light chains, each light chain comprising a VL and CL domain of a Fab fragment capable of specific binding to CD40, and
(c) a crossover fab fragment capable of specific binding to FAP comprising a VL-CH1 chain and a VH-CL chain, wherein the VL-CH1 chain is connected to the C-terminus of one of the two heavy chains of (a).

In one aspect, the VL-CH1 chain is connected to the C-terminus of the FC knob heavy chain.

In a particular aspect, the invention provides a bispecific antigen binding molecule comprising
(a) two light chains, each comprising the amino acid sequence of SEQ ID NO:165, one light chain comprising the amino acid sequence of SEQ ID NO: 162, a first heavy chain comprising the amino acid sequence of SEQ ID NO: 167, and a second heavy chain comprising the amino acid sequence of SEQ ID NO: 168, or
(b) two light chains, each comprising the amino acid sequence of SEQ ID NO:248, one light chain comprising the amino acid sequence of SEQ ID NO: 162, a first heavy chain comprising the amino acid sequence of SEQ ID NO:251, and a second heavy chain comprising the amino acid sequence of SEQ ID NO:252, or
(c) two light chains, each comprising the amino acid sequence of SEQ ID NO:248, one light chain comprising the amino acid sequence of SEQ ID NO: 138, a first heavy chain comprising the amino acid sequence of SEQ ID NO:253, and a second heavy chain comprising the amino acid sequence of SEQ ID NO:252, or
(d) two light chains, each comprising the amino acid sequence of SEQ ID NO:248, one light chain comprising the amino acid sequence of SEQ ID NO:254, a first heavy chain comprising the amino acid sequence of SEQ ID NO:255, and a second heavy chain comprising the amino acid sequence of SEQ ID NO:252, or
(e) two light chains, each comprising the amino acid sequence of SEQ ID NO:256, one light chain comprising the amino acid sequence of SEQ ID NO:254, a first heavy chain comprising the amino acid sequence of SEQ ID NO:257, and a second heavy chain comprising the amino acid sequence of SEQ ID NO:258.

Bispecific Antigen Binding Molecules in Head-to-Tail Format (2+1)

In another aspect, provided is a bispecific antigen binding molecule, comprising
(a) a heavy chain comprising a VH and CH1 domain of a Fab fragment capable of specific binding to CD40 and a Fc region subunit,
(b) a heavy chain comprising a VH and CH1 domain of a Fab fragment capable of specific binding to CD40, a VL and CH1 domain of a Fab fragment capable of specific binding to FAP and a Fc region subunit,
(c) two light chains, each light chain comprising a VL and CL domain of a Fab fragment capable of specific binding to CD40, and
(d) a light chain comprising a VH and CL domain of a Fab fragment capable of specific binding to FAP.

In particular, provided is a bispecific antigen binding molecule comprising a first heavy chain comprising the amino acid sequence of SEQ ID NO: 164, a second heavy chain comprising the amino acid sequence of SEQ ID NO:166, two light chains each comprising the amino acid sequence of SEQ ID NO:165 and a light chain comprising the amino acid sequence of SEQ ID NO: 162.

Bispecific Antigen Binding Molecules Bivalent for Binding to CD40 and Bivalent for Binding to the Target Cell Antigen (2+2 Format)

In another aspect, the invention provides a bispecific antigen binding molecule comprising
(a) two antigen binding domains capable of specific binding to CD40,
(b) two antigen binding domains capable of specific binding to the target cell antigen, and
(c) a Fc domain composed of a first and a second subunit capable of stable association.

Thus, provided is a bispecific antigen binding molecule, wherein the bispecific antigen binding molecule is bivalent for CD40 and bivalent for the target cell antigen.

In one aspect, provided is a bispecific antigen binding molecule, wherein the bispecific antigen binding molecule comprises
(a) two heavy chains, each heavy chain comprising a VH and CH1 domain of a Fab fragment capable of specific binding to CD40, and a Fc region subunit,
(b) two light chains, each light chain comprising a VL and CL domain of a Fab fragment capable of specific binding to CD40, and
(c) two Fab fragments capable of specific binding to FAP, wherein one of the Fab fragments is connected to the C-terminus of one of the two heavy chains of (a), and the other of the Fab fragments is connected to the C-terminus of the other of the two heavy chains of (a).

In a particular aspect, the invention provides a bispecific antigen binding molecule comprising
(a) two light chains, each comprising the amino acid sequence of SEQ ID NO:86, two light chains, each comprising the amino acid sequence of SEQ ID NO:87, and two heavy chains, each comprising the amino acid sequence of SEQ ID NO:90, or
(b) two light chains, each comprising the amino acid sequence of SEQ ID NO:137, two light chains, each comprising the amino acid sequence of SEQ ID NO:138, and two heavy chains, each comprising the amino acid sequence of SEQ ID NO:136.

Bispecific Antigen Binding Molecules Tetravalent for Binding to CD40 and Monovalent for Binding to the Target Cell Antigen (4+1 Format)

In another aspect, the invention provides a bispecific antigen binding molecule comprising
(a) four antigen binding domains capable of specific binding to CD40,
(b) one antigen binding domain capable of specific binding to a target cell antigen, and
(c) a Fc domain composed of a first and a second subunit capable of stable association:

Thus, provided is a bispecific antigen binding molecule, wherein the bispecific antigen binding molecule is tetravalent for CD40 and monovalent for the target cell antigen.

In one aspect, provided is a bispecific antigen binding molecule, wherein the four antigen binding domains capable of specific binding to CD40 are Fab fragments and each two thereof are fused to each other at the heavy chain, optionally via a peptide linker. In a particular aspect, the peptide linker comprises the amino acid sequence of SEQ ID NO: 148. More particularly, the antigen binding molecule comprises two heavy chains comprising each a VHCH1-peptide linker-VHCH1 fragment. In a particular aspect, the peptide linker has the amino acid sequence of SEQ ID NO: 148.

In another aspect, a bispecific antigen binding molecule is provided, wherein the antigen binding domain capable of specific binding to a target cell antigen comprises a VH and VL domain and wherein the VH domain is connected via a peptide linker to the C-terminus of the first subunit of the Fc domain and the VL domain is connected via a peptide linker to the C-terminus of the second subunit of the Fc domain.

In a particular aspect, the bispecific antigen binding molecule comprises
(a) four light chains, each light chain comprising a VL and CL domain of a Fab fragment capable of specific binding to CD40,
(b) two heavy chains, wherein each of the heavy chain comprises a VH and CH1 domain of a Fab fragment capable of specific binding to CD40 fused to a VH and CH1 domain of a second Fab fragment capable of specific binding to CD40, and a Fc region subunit, and
(c) a VH and VL domain capable of specific binding to a target cell antigen, wherein the VH domain is connected via a peptide linker to the C-terminus of one of the heavy chains and wherein the VL domain is connected via a peptide linker to the C-terminus of the second heavy chain.

In a particular aspect, the peptide linker comprises an amino acid sequence selected from SEQ ID NO: 147, SEQ ID NO: 148, SEQ ID NO: 152 and SEQ ID NO:153. More particularly, the peptide linker comprises the SEQ ID NO: 153.

In one aspect, provided is a bispecific antigen binding molecule comprising
(a) four light chains, each light chain comprising a light chain variable region ($V_L$CD40) comprising an amino acid sequence selected from the group consisting of SEQ ID NO:26, SEQ ID NO: 34, SEQ ID NO: 175, SEQ ID NO: 176, SEQ ID NO: 177, SEQ ID NO: 178, SEQ ID NO: 185, SEQ ID NO: 186, SEQ ID NO: 187 and SEQ ID NO: 188,
(b) two heavy chains, wherein each of the heavy chain comprises VH-CH1-VH-CH1 and a Fc region subunit, and wherein both VH domains comprise a heavy chain variable region ($V_H$CD40) comprising an amino acid sequence selected from the group consisting of SEQ ID NO: 25, SEQ ID NO:33, SEQ ID NO: 171, SEQ ID NO: 172, SEQ ID NO: 173, SEQ ID NO: 174, SEQ ID NO: 179, SEQ ID NO: 180, SEQ ID NO: 181, SEQ ID NO: 182, SEQ ID NO: 183 and SEQ ID NO: 184, and
(c) a VH and VL domain capable of specific binding to a target cell antigen, wherein the VH domain is connected via a peptide linker to the C-terminus of one of the heavy chains and wherein the VL domain is connected via a peptide linker to the C-terminus of the second heavy chain.

In one aspect, the invention relates to a bispecific antigen binding molecule, comprising (a) four Fab fragments capable of specific binding to CD40, (b) a VH and a VL domain capable of specific binding to FAP, and (c) a Fc domain composed of a first and a second subunit capable of stable association.

In particular, the VH domain is a heavy chain variable region ($V_H$FAP) comprising an amino acid sequence of SEQ ID NO:9 or of SEQ ID NO: 17 and the VL domain is a light chain variable region ($V_L$FAP) comprising an amino acid sequence of SEQ ID NO:10 or of SEQ ID NO: 18. More particularly, the VH domain is a heavy chain variable region ($V_H$FAP) comprising an amino acid sequence of SEQ ID NO: 17 and the VL domain is a light chain variable region ($V_L$FAP) comprising an amino acid sequence of SEQ ID NO: 18.

In a particular aspect, the invention provides a bispecific antigen binding molecule comprising
(a) four light chains, each comprising the amino acid sequence of SEQ ID NO:82, a first heavy chain comprising the amino acid sequence of SEQ ID NO:83, and a second heavy chain comprising the amino acid sequence of SEQ ID NO:84, or
(b) four light chains, each comprising the amino acid sequence of SEQ ID NO: 133, a first heavy chain comprising the amino acid sequence of SEQ ID NO: 131, and a second heavy chain comprising the amino acid sequence of SEQ ID NO: 132.

In another particular aspect, the invention provides a bispecific antigen binding molecule capable of specific binding to murine CD40 comprising
(a) four light chains, each comprising the amino acid sequence of SEQ ID NO:97, a first heavy chain comprising the amino acid sequence of SEQ ID NO:95, and a second heavy chain comprising the amino acid sequence of SEQ ID NO:96.

In one aspect, provided is a bispecific antigen binding molecule, wherein the bispecific antigen binding molecule comprises
(a) four light chains, each light chain comprising a VL and CL domain of a Fab fragment capable of specific binding to CD40,
(b) two heavy chains, wherein each of the heavy chain comprises a VH and CH1 domain of a Fab fragment capable of specific binding to CD40 fused to a VH and CH1 domain of a second Fab fragment capable of specific binding to CD40, and a Fc region subunit, and
(c) one Fab fragment capable of specific binding to FAP, wherein the Fab fragment is connected to the C-terminus of one of the two heavy chains of (b).

In particular, the Fab fragment capable of specific binding is a crossover fab fragment.

In one aspect, provided is a bispecific antigen binding molecule, wherein the bispecific antigen binding molecule comprises
(a) two heavy chains, each heavy chain comprising a VH and CH1 domain of a Fab fragment capable of specific binding to CD40, and a Fc region subunit,
(b) two light chains, each light chain comprising a VL and CL domain of a Fab fragment capable of specific binding to CD40, and
(c) one Fab fragment capable of specific binding to FAP, wherein the Fab fragment is connected to the C-terminus of one of the two heavy chains of (a).

In particular, the Fab fragment capable of specific binding is a crossover fab fragment.

In a further aspect, provided is a bispecific antigen binding molecule, comprising (a) four light chains, each light chain comprising a VL and CL domain of a Fab fragment capable of specific binding to CD40, wherein the VL comprises a light chain variable region ($V_L$CD40) comprising an amino acid sequence selected from the group consisting of SEQ ID NO: 26, SEQ ID NO:34, SEQ ID NO: 175, SEQ ID NO: 176, SEQ ID NO: 177, SEQ ID NO: 178, SEQ ID NO: 185, SEQ ID NO: 186, SEQ ID NO: 187 and SEQ ID NO: 188, and (b) two heavy chains, each heavy chain comprising a VH-CH1-VH-CH1 chain and a Fc region subunit, wherein both VH domains comprise a heavy chain variable region ($V_H$CD40) comprising an amino acid sequence selected from the group consisting of SEQ ID NO:25, SEQ ID NO: 33, SEQ ID NO: 171, SEQ ID NO: 172, SEQ ID NO: 173, SEQ ID NO: 174, SEQ ID NO: 179, SEQ ID NO: 180, SEQ ID NO: 181, SEQ ID NO: 182, SEQ ID NO: 183 and SEQ ID NO: 184, and (c) a crossover Fab fragment capable of specific binding to FAP comprising a VL-CH1 chain and a VH-CL chain, wherein the VH-CL chain is connected to the C-terminus of one of the two heavy chains of (b).

In one aspect, the VH-CL chain is connected to the C-terminus of the FC knob heavy chain.

In a further aspect, provided is a bispecific antigen binding molecule, comprising (a) four light chains, each light chain comprising a VL and CL domain of a Fab fragment capable of specific binding to CD40, wherein the VL comprises a light chain variable region ($V_L$CD40) comprising an amino acid sequence selected from the group consisting of SEQ ID NO: 26, SEQ ID NO:34, SEQ ID NO: 175, SEQ ID NO: 176, SEQ ID NO: 177, SEQ ID NO:178, SEQ ID NO: 185, SEQ ID NO: 186, SEQ ID NO: 187 and SEQ ID NO:188, and (b) two heavy chains, each heavy chain comprising a VH-CH1-VH-CH1 chain and a Fc region subunit, wherein both VH domains comprise a heavy chain variable region ($V_H$CD40) comprising an amino acid sequence selected from the group consisting of SEQ ID NO:25, SEQ ID NO: 33, SEQ ID NO: 171, SEQ ID NO: 172, SEQ ID NO: 173, SEQ ID NO: 174, SEQ ID NO: 179, SEQ ID NO: 180, SEQ ID NO: 181, SEQ ID NO: 182, SEQ ID NO: 183 and SEQ ID NO: 184, and (c) a crossover fab fragment capable of specific binding to FAP comprising a VL-CH1 chain and a VH-CL chain, wherein the VL-CH1 chain is connected to the C-terminus of one of the two heavy chains of (b).

In one aspect, the VL-CH1 chain is connected to the C-terminus of the FC knob heavy chain.

In a particular aspect, the invention provides a bispecific antigen binding molecule comprising (a) four light chains, each comprising the amino acid sequence of SEQ ID NO: 165, one light chain comprising the amino acid sequence of SEQ ID NO: 162, a first heavy chain comprising the amino acid sequence of SEQ ID NO: 169, and a second heavy chain comprising the amino acid sequence of SEQ ID NO: 170, or (b) two light chains, each comprising the amino acid sequence of SEQ ID NO:243, one light chain comprising the amino acid sequence of SEQ ID NO: 162, a first heavy chain comprising the amino acid sequence of SEQ ID NO:244, and a second heavy chain comprising the amino acid sequence of SEQ ID NO:245, or (c) two light chains, each comprising the amino acid sequence of SEQ ID NO:243, one light chain comprising the amino acid sequence of SEQ ID NO:162, a first heavy chain comprising the amino acid sequence of SEQ ID NO:246, and a second heavy chain comprising the amino acid sequence of SEQ ID NO:247, or (d) two light chains, each comprising the amino acid sequence of SEQ ID NO:248, one light chain comprising the amino acid sequence of SEQ ID NO:162, a first heavy chain comprising the amino acid sequence of SEQ ID NO:249, and a second heavy chain comprising the amino acid sequence of SEQ ID NO:250.

Bispecific Antigen Binding Molecules Tetravalent for Binding to CD40 and Bivalent for Binding to the Target Cell Antigen (4+2 Format)

In another aspect, the invention provides a bispecific antigen binding molecule comprising (a) four antigen binding domains capable of specific binding to CD40, (b) two antigen binding domains capable of specific binding to a target cell antigen, and (c) a Fc domain composed of a first and a second subunit capable of stable association:

Thus, provided is a bispecific antigen binding molecule, wherein the bispecific antigen binding molecule is tetravalent for CD40 and bivalent for the target cell antigen.

In one aspect, provided is a bispecific antigen binding molecule, wherein the four antigen binding domains capable of specific binding to CD40 are Fab fragments and each two thereof are fused to each other, optionally via a peptide linker. In a particular aspect, the peptide linker comprises the amino acid sequence of SEQ ID NO:148. More particularly, the antigen binding molecule comprises two heavy chains comprising each a VHCH1-peptide linker-VHCH1 fragment. In a particular aspect, the peptide linker has the amino acid sequence of SEQ ID NO: 148.

In another aspect, a bispecific antigen binding molecule is provided, wherein the antigen binding domains capable of specific binding to a target cell antigen are Fab fragments and wherein the first Fab fragment is connected via a peptide linker to the C-terminus of the first subunit of the Fc domain and the second Fab fragment is connected via a peptide linker to the C-terminus of the second subunit of the Fc domain. In one aspect, the two Fab fragments capable of specific binding to the target cell antigen are crossover Fab fragments each comprising a VL-CH1 chain and a VH-CL chain, and wherein the VL-CH1 chain is connected to the C-terminus of one of the two heavy chains.

In a particular aspect, the invention provides a bispecific antigen binding molecule comprising four light chains, each comprising the amino acid sequence of SEQ ID NO:86, two light chains, each comprising the amino acid sequence of SEQ ID NO:87, and two heavy chains comprising the amino acid sequence of SEQ ID NO:85.

In another aspect, the invention provides a bispecific antigen binding molecule capable of specific binding to murine CD40 comprising four light chains, each comprising the amino acid sequence of SEQ ID NO: 100, two light chains, each comprising the amino acid sequence of SEQ ID NO: 99, and two heavy chains comprising the amino acid sequence of SEQ ID NO:98.

Fc Domain Modifications Reducing Fc Receptor Binding and/or Effector Function

The bispecific antigen binding molecules of the invention further comprise a Fc domain composed of a first and a second subunit capable of stable association.

In certain aspects, one or more amino acid modifications may be introduced into the Fc region of an antibody provided herein, thereby generating an Fc region variant. The Fc region variant may comprise a human Fc region sequence (e.g., a human IgG1. IgG2. IgG3 or IgG4 Fc region) comprising an amino acid modification (e.g. a substitution) at one or more amino acid positions.

The Fc domain confers favorable pharmacokinetic properties to the bispecific antibodies of the invention, including a long serum half-life which contributes to good accumulation in the target tissue and a favorable tissue-blood distribution ratio. At the same time it may, however, lead to undesirable targeting of the bispecific antibodies of the invention to cells expressing Fc receptors rather than to the preferred antigen-bearing cells. Accordingly, in particular embodiments the Fc domain of the bispecific antibodies of the invention exhibits reduced binding affinity to an Fc receptor and/or reduced effector function, as compared to a native IgG Fc domain, in particular an IgG1 Fc domain or an IgG4 Fc domain. More particularly, the Fc domain is an IgG1 Fc domain.

In one such aspect the Fc domain (or the bispecific antigen binding molecule of the invention comprising said Fc domain) exhibits less than 50%, preferably less than 20%, more preferably less than 10% and most preferably less than 5% of the binding affinity to an Fc receptor, as compared to a native IgG1 Fc domain (or the bispecific antigen binding molecule of the invention comprising a native IgG1 Fc domain), and/or less than 50%, preferably less than 20%, more preferably less than 10% and most preferably less than 5% of the effector function, as compared to a native IgG1 Fc domain (or the bispecific antigen binding molecule of the invention comprising a native IgG1 Fc domain). In one aspect, the Fc domain (or the bispecific antigen binding molecule of the invention comprising said Fc domain) does not substantially bind to an Fc receptor and/or induce effector function. In a particular aspect the Fc receptor is an Fcγ receptor. In one aspect, the Fc receptor is a human Fc receptor. In one aspect, the Fc receptor is an activating Fc receptor. In a specific aspect, the Fc receptor is an activating human Fcγ receptor, more specifically human FcγRIIIa. FcγRI or FcγRIIa, most specifically human FcγRIIIa. In one aspect, the Fc receptor is an inhibitory Fc receptor. In a specific aspect, the Fc receptor is an inhibitory human Fcγ receptor, more specifically human FcγRIIB. In one aspect the effector function is one or more of CDC. ADCC. ADCP, and cytokine secretion. In a particular aspect, the effector function is ADCC. In one aspect, the Fc domain exhibits substantially similar binding affinity to neonatal Fc receptor (FcRn), as compared to a native IgG1 Fc domain. Substantially similar binding to FcRn is achieved when the Fc domain (or the bispecific antigen binding molecule of the invention comprising said Fc domain) exhibits greater than about 70%, particularly greater than about 80%, more particularly greater than about 90% of the binding affinity of a native IgG1 Fc domain (or the bispecific antigen binding molecule of the invention comprising a native IgG1 Fc domain) to FcRn.

In a particular aspect, the Fc domain is engineered to have reduced binding affinity to an Fc receptor and/or reduced effector function, as compared to a non-engineered Fc domain. In a particular aspect, the Fc domain of the bispecific antigen binding molecule of the invention comprises one or more amino acid mutation that reduces the binding affinity of the Fc domain to an Fc receptor and/or effector function. Typically, the same one or more amino acid mutation is present in each of the two subunits of the Fc domain. In one aspect, the amino acid mutation 20) reduces the binding affinity of the Fc domain to an Fc receptor. In another aspect, the amino acid mutation reduces the binding affinity of the Fc domain to an Fc receptor by at least 2-fold, at least 5-fold, or at least 10-fold. In one aspect, the bispecific antigen binding molecule of the invention comprising an engineered Fc domain exhibits less than 20%, particularly less than 10%, more particularly less than 5% of the binding affinity to an Fc receptor as compared to bispecific antibodies of the invention comprising a non-engineered Fc domain. In a particular aspect, the Fc receptor is an Fcγ receptor. In other aspects, the Fc receptor is a human Fc receptor. In one aspect, the Fc receptor is an inhibitory Fc receptor. In a specific aspect, the Fc receptor is an inhibitory human Fcγ receptor, more specifically human FcγRIIB. In some aspects the Fc receptor is an activating Fc receptor. In a specific aspect, the Fc receptor is an activating human Fcγ receptor, more specifically human FcγRIIIa. FcγRI or FcγRIIa, most specifically human FcγRIIIa. Preferably, binding to each of these receptors is reduced. In some aspects, binding affinity to a complement component, specifically binding affinity to C1q, is also reduced. In one aspect, binding affinity to neonatal Fc receptor (FcRn) is not reduced. Substantially similar binding to FcRn, i.e. preservation of the binding affinity of the Fc domain to said receptor, is achieved when the Fc domain (or the bispecific antigen binding molecule of the invention comprising said Fc domain) exhibits greater than about 70% of the binding affinity of a non-engineered form of the Fc domain (or the bispecific antigen binding molecule of the invention comprising said non-engineered form of the Fc domain) to FcRn. The Fc domain, or the bispecific antigen binding molecule of the invention comprising said Fc domain, may exhibit greater than about 80% and even greater than about 90% of such affinity. In certain embodiments the Fc domain of the bispecific antigen binding molecule of the invention is engineered to have reduced effector function, as compared to a non-engineered Fc domain. The reduced effector function can include, but is not limited to, one or more of the following: reduced complement dependent cytotoxicity (CDC), reduced antibody-dependent cell-mediated cytotoxicity (ADCC), reduced antibody-dependent cellular phagocytosis (ADCP), reduced cytokine secretion, reduced immune complex-mediated antigen uptake by antigen-presenting cells, reduced binding to NK cells, reduced binding to macrophages, reduced binding to monocytes, reduced binding to polymorphonuclear cells, reduced direct signaling inducing apoptosis, reduced dendritic cell maturation, or reduced T cell priming.

Antibodies with reduced effector function include those with substitution of one or more of Fc region residues 238, 265, 269, 270, 297, 327 and 329 (U.S. Pat. No. 6,737,056), Such Fc mutants include Fc mutants with substitutions at two or more of amino acid positions 265, 269, 270, 297 and 327, including the so-called "DANA" Fc mutant with substitution of residues 265 and 297 to alanine (U.S. Pat. No. 7,332,581). Certain antibody variants with improved or diminished binding to FcRs are described. (e.g. U.S. Pat. No. 6,737,056: WO 2004/056312, and Shields. R. L. et al., J. Biol. Chem. 276 (2001) 6591-6604). 20)

In one aspect of the invention, the Fc domain comprises an amino acid substitution at a position of E233. L234. L235, N297, P331 and P329. In some aspects, the Fc domain comprises the amino acid substitutions L234A and L235A ("LALA"). In one such embodiment, the Fc domain is an IgG1 Fc domain, particularly a human IgG1 Fc domain. In one aspect, the Fc domain comprises an amino acid substitution at position P329. In a more specific aspect, the amino acid substitution is P329A or P329G, particularly P329G. In one embodiment the Fc domain comprises an amino acid substitution at position P329 and a further amino acid substitution selected from the group consisting of E233P. L234A, L235A. L235E. N297A. N297D or P331S. In more particular embodiments the Fc domain comprises the amino acid mutations L234A. L235A and P329G ("P329G LALA"). The "P329G LALA" combination of amino acid substitutions almost completely abolishes Fcγ receptor binding of a human IgG1 Fc domain, as described in PCT Patent Application No. WO 2012/130831 A1. Said document also describes methods of preparing such mutant Fc domains and methods for determining its properties such as Fc receptor binding or effector functions. Such antibody is an IgG1 with mutations L234A and L235A or with mutations L234A. L235A and P329G (numbering according to EU index of Kabat et al. Kabat et al., Sequences of Proteins of Immunological Interest. 5th Ed. Public Health Service. National Institutes of Health, Bethesda, MD, 1991).

In one aspect, the Fc domain is an IgG4 Fc domain. In a more specific embodiment, the Fc domain is an IgG4 Fc domain comprising an amino acid substitution at position S228 (Kabat numbering), particularly the amino acid substitution S228P. In a more specific embodiment, the Fc domain is an IgG4 Fc domain comprising amino acid substitutions L235E and S228P and P329G. This amino acid substitution reduces in vivo Fab arm exchange of IgG4 antibodies (see Stubenrauch et al., Drug Metabolism and Disposition 38, 84-91 (2010)).

Antibodies with increased half lives and improved binding to the neonatal Fc receptor (FcRn), which is responsible for the transfer of maternal IgGs to the fetus (Guyer. R. L. et al., J. Immunol. 117 (1976) 587-593, and Kim. J. K. et al., J. Immunol. 24 (1994) 2429-2434), are described in US 2005/0014934. Those antibodies comprise an Fc region with one or more substitutions therein which improve binding of the Fc region to FcRn. Such Fc variants include those with substitutions at one or more of Fc region residues: 238, 256, 265, 272, 286, 303, 305, 307, 311, 312, 317, 340, 356, 360, 362, 376, 378, 380, 382, 413, 424 or 434, e.g., substitution of Fc region residue 434 (U.S. Pat. No. 7,371,826), See also Duncan. A. R, and Winter. G., Nature 322 (1988) 738-740: U.S. Pat. No. 5,648,260: U.S. Pat. No. 5,624,821; and WO 94/29351 concerning other examples of Fc region variants.

Binding to Fc receptors can be easily determined e.g. by ELISA, or by Surface Plasmon Resonance (SPR) using standard instrumentation such as a BIACORE® instrument (GE Healthcare), and Fc receptors such as may be obtained by recombinant expression. A suitable such binding assay is described herein. Alternatively, binding affinity of Fc domains or cell activating bispecific antigen binding molecules comprising an Fc domain for Fc receptors may be evaluated using cell lines known to express particular Fc receptors, such as human NK cells expressing FcγIIIa receptor. Effector function of an Fc domain, or bispecific antigen binding molecules of the invention comprising an Fc domain, can be measured by methods known in the art. A suitable assay for measuring ADCC is described herein. Other examples of in vitro assays to assess ADCC activity of a molecule of interest are described in U.S. Pat. No. 5,500,362; Hellstrom et al. Proc Natl Acad Sci USA 83, 7059-7063 (1986) and Hellstrom et al., Proc Natl Acad Sci USA 82, 1499-1502 (1985): U.S. Pat. No. 5,821,337; Bruggemann et al., J Exp Med 166, 1351-1361 (1987). Alternatively, non-radioactive assays methods may be employed (see, for example, ACTI™ non-radioactive cytotoxicity assay for flow cytometry (CellTechnology. Inc. Mountain View. CA); and CYTOTOX 96® non-radioactive cytotoxicity assay (Promega. Madison, WI)). Useful effector cells for such assays include peripheral blood mononuclear cells (PBMC) and Natural Killer (NK) cells. Alternatively, or additionally. ADCC activity of the molecule of interest may be assessed in vivo, e.g. in an animal model such as that disclosed in Clynes et al., Proc Natl Acad Sci USA 95, 652-656 (1998).

The following section describes preferred aspects of the bispecific antigen binding molecules of the invention comprising Fc domain modifications reducing Fc receptor binding and/or effector function. In one aspect, the invention relates to the bispecific antigen binding molecule (a) at least one antigen binding domain capable of specific binding to CD40. (b) at least one antigen binding domain capable of specific binding to a target cell antigen, and (c) a Fc domain composed of a first and a second subunit capable of stable association, wherein the Fc domain comprises one or more amino acid substitution that reduces the binding affinity of the antibody to an Fc receptor, in particular towards Fcγ receptor. In another aspect, the invention relates to the bispecific antigen binding molecule comprising (a) at least one antigen binding domain capable of specific binding to CD40. (b) at least one antigen binding domain capable of specific binding to a target cell antigen, and (c) a Fc domain composed of a first and a second subunit capable of stable association, wherein the Fc domain comprises one or more amino acid substitution that reduces effector function. In particular aspect, the Fc domain is of human IgG1 subclass with the amino acid mutations L234A. L235A and P329G (numbering according to Kabat EU index).

Fc Domain Modifications Promoting Heterodimerization

The bispecific antigen binding molecules of the invention comprise different antigen-binding sites, fused to one or the other of the two subunits of the Fc domain, thus the two subunits of the Fc domain may be comprised in two non-identical polypeptide chains.

Recombinant co-expression of these polypeptides and subsequent dimerization leads to several possible combinations of the two polypeptides. To improve the yield and purity of the bispecific antigen binding molecules of the invention in recombinant production, it will thus be advantageous to introduce in the Fc domain of the bispecific antigen binding molecules of the invention a modification promoting the association of the desired polypeptides.

Accordingly, in particular aspects the invention relates to the bispecific antigen binding molecule comprising (a) at least one antigen binding domain capable of specific binding to CD40. (b) at least one antigen binding domain capable of specific binding to a target cell antigen, and (c) a Fc domain composed of a first and a second subunit capable of stable association, wherein the Fc domain comprises a modification promoting the association of the first and second subunit of the Fc domain. The site of most extensive protein-protein interaction between the two subunits of a human IgG Fc domain is in the CH3 domain of the Fc domain. Thus, in one aspect said modification is in the CH3 domain of the Fc domain.

In a specific aspect said modification is a so-called "knob-into-hole" modification, comprising a "knob" modification in one of the two subunits of the Fc domain and a "hole" modification in the other one of the two subunits of the Fc domain. Thus, the invention relates to the bispecific antigen binding molecule comprising (a) at least one antigen binding domain capable of specific binding to CD40. (b) at least one antigen binding domain capable of specific binding to a target cell antigen, and (c) a Fc domain composed of a first and a second subunit capable of stable association, wherein the first subunit of the Fc domain comprises knobs and the second subunit of the Fc domain comprises holes according to the knobs into holes method. In a particular aspect, the first subunit of the Fc domain comprises the amino acid substitutions S354C and T366W (EU numbering) and the second subunit of the Fc domain comprises the amino acid substitutions γ349C. T366S and γ407V (numbering according to Kabat EU index).

The knob-into-hole technology is described e.g. in U.S. Pat. Nos. 5,731,168; 7,695,936; Ridgway et al., Prot Eng 9, 617-621 (1996) and Carter. J Immunol Meth 248, 7-15 (2001), Generally, the method involves introducing a protuberance ("knob") at the interface of a first polypeptide and a corresponding cavity ("hole") in the interface of a second polypeptide, such that the protuberance can be positioned in the cavity so as to promote heterodimer formation and hinder homodimer formation. Protuberances are constructed by replacing small amino acid side chains from the interface of the first polypeptide with larger side chains (e.g. tyrosine or tryptophan). Compensatory cavities of identical or similar size to the protuberances are created in the interface of the second polypeptide by replacing large amino acid side chains with smaller ones (e.g. alanine or threonine).

Accordingly, in one aspect, in the CH3 domain of the first subunit of the Fc domain of the bispecific antigen binding molecules of the invention an amino acid residue is replaced with an amino acid residue having a larger side chain volume, thereby generating a protuberance within the CH3 domain of the first subunit which is positionable in a cavity within the CH3 domain of the second subunit, and in the CH3 domain of the second subunit of the Fc domain an amino acid residue is replaced with an amino acid residue having a smaller side chain volume, thereby generating a cavity within the CH3 domain of the second subunit within which the protuberance within the CH3 domain of the first subunit is positionable. The protuberance and cavity can be made by altering the nucleic acid encoding the polypeptides, e.g. by site-specific mutagenesis, or by peptide synthesis. In a specific aspect, in the CH3 domain of the first subunit of the Fc domain the threonine residue at position 366 is replaced with a tryptophan residue (T366W), and in the CH3 domain of the second subunit of the Fc domain the tyrosine residue at position 407 is replaced with a valine residue (γ407V). In one aspect, in the second subunit of the Fc domain additionally the threonine residue at position 366 is replaced with a serine residue (T366S) and the leucine residue at position 368 is replaced with an alanine residue (L368A).

In yet a further aspect, in the first subunit of the Fc domain additionally the serine residue at position 354 is replaced with a cysteine residue (S354C), and in the second subunit of the Fc domain additionally the tyrosine residue at position 349 is replaced by a cysteine residue (γ349C). Introduction of these two cysteine residues results in formation of a disulfide bridge between the two subunits of the Fc domain, further stabilizing the dimer (Carter (2001), *J Immunol Methods* 248, 7-15). In a particular aspect, the first subunit of the Fc domain comprises the amino acid substitutions S354C and T366W (EU numbering) and the second subunit of the Fc domain comprises the amino acid substitutions γ349C, T366S and γ407V (numbering according to Kabat EU index).

In an alternative aspect, a modification promoting association of the first and the second subunit of the Fc domain comprises a modification mediating electrostatic steering effects, e.g. as described in PCT publication WO 2009/089004. Generally, this method involves replacement of one or more amino acid residues at the interface of the two Fc domain subunits by charged amino acid residues so that homodimer formation becomes electrostatically unfavorable but heterodimerization electrostatically favorable.

The C-terminus of the heavy chain of the bispecific antibody as reported herein can be a complete C-terminus ending with the amino acid residues PGK. The C-terminus of the heavy chain can be a shortened C-terminus in which one or two of the C terminal amino acid residues have been removed. In one preferred aspect, the C-terminus of the heavy chain is a shortened C-terminus ending PG. In one aspect of all aspects as reported herein, a bispecific antibody comprising a heavy chain including a C-terminal CH3 domain as specified herein, comprises the C-terminal glycine-lysine dipeptide (G446 and K447, numbering according to Kabat EU index). In one embodiment of all aspects as reported herein, a bispecific antibody comprising a heavy chain including a C-terminal CH3 domain, as specified herein, comprises a C-terminal glycine residue (G446, numbering according to Kabat EU index).

Modifications in the Fab Domains

In one aspect, the invention relates to a bispecific antigen binding molecule comprising (a) a first Fab fragment capable of specific binding to CD40, (b) a second Fab fragment capable of specific binding to a target cell antigen, and (c) a Fc domain composed of a first and a second subunit capable of stable association, wherein in one of the Fab fragments either the variable domains VH and VL or the constant domains CH1 and CL are exchanged. The bispecific antibodies are prepared according to the CrossMAb technology.

Multispecific antibodies with a domain replacement/exchange in one binding arm (CrossMAbVH-VL or CrossMAbCH-CL) are described in detail in WO2009/080252 and Schaefer, W. et al, PNAS, 108 (2011) 11187-1191. They clearly reduce the byproducts caused by the mismatch of a light chain against a first antigen with the wrong heavy chain against the second antigen (compared to approaches without such domain exchange).

In one aspect, the invention relates to a bispecific antigen binding molecule comprising (a) a first Fab fragment capable of specific binding to CD40. (b) a second Fab fragment capable of specific binding to a target cell antigen, and (c) a Fc domain composed of a first and a second subunit capable of stable association, wherein in one of the Fab fragments the constant domains CL and CH1 are replaced by each other so that the CH1 domain is part of the light chain and the CL domain is part of the heavy chain. More particularly, in the second Fab fragment capable of specific binding to a target cell antigen the constant domains CL and CH1 are replaced by each other so that the CH1 domain is part of the light chain and the CL domain is part of the heavy chain.

In a particular aspect, the invention relates a bispecific antigen binding molecule comprising (a) a first Fab fragment capable of specific binding to CD40. (b) a second Fab fragment capable of specific binding to a target cell antigen, wherein the constant domains CL and CH1 are replaced by each other so that the CH1 domain is part of the light chain and the CL domain is part of the heavy chain. Such a molecule is called a monovalent bispecific antigen binding molecule.

In another aspect, the invention relates to a bispecific antigen binding molecule, comprising (a) two light chains and two heavy chains of an antibody comprising two Fab fragments capable of specific binding to CD40 and the Fc domain, and (b) two additional Fab fragments capable of specific binding to a target cell antigen, wherein said additional Fab fragments are each connected via a peptide linker to the C-terminus of the heavy chains of (a). In a particular aspect, the additional Fab fragments are Fab fragments, wherein the variable domains VL and VH are replaced by each other so that the VH domain is part of the light chain and the VL domain is part of the heavy chain.

Thus, in a particular aspect, the invention comprises a bispecific antigen binding molecule, comprising (a) two light chains and two heavy chains of an antibody comprising two Fab fragments capable of specific binding to CD40 and the Fc domain, and (b) two additional Fab fragments capable of specific binding to a target cell antigen, wherein said two additional Fab fragments capable of specific binding to a target cell antigen are crossover Fab fragments wherein the variable domains VL and VH are replaced by each other and the VL-CH chains are each connected via a peptide linker to the C-terminus of the heavy chains of (a).

In another aspect, and to further improve correct pairing, the bispecific antigen binding molecule comprising (a) a first Fab fragment capable of specific binding to CD40. (b) a second Fab fragment capable of specific binding to a target cell antigen, and (c) a Fc domain composed of a first and a second subunit capable of stable association, can contain different charged amino acid substitutions (so-called "charged residues"). These modifications are introduced in the crossed or non-crossed CH1 and CL domains. In a particular aspect, the invention relates to a bispecific antigen binding molecule, wherein in one of CL domains the amino acid at position 123 (EU numbering) has been replaced by arginine (R) and the amino acid at position 124 (EU numbering) has been substituted by lysine (K) and wherein in one of the CH1 domains the amino acids at position 147 (EU numbering) and at position 213 (EU numbering) have been substituted by glutamic acid (E).

Exemplary Antibodies of the Invention

In one aspect, the invention provides new antibodies and antibody fragments that specifically bind to CD40. These antibodies have superior properties compared to the known CD40 antibodies that make them especially suitable for the incorporation into bispecific antigen binding molecules comprising another antigen binding moiety capable of specific binding to a target cell antigen. The new antibodies are further characterized in that they are producible in high amounts and with high titers, that they show high thermal stability (as measured by the aggregation temperature Tagg), or in that they possess a high degree of humanness and may therefore be less immunogenic in the human body. The percentage of humanness of the VH and VL sequences as compared to the human germline sequences can be determined by the methods described in Abhinandan, K. R, and Martin, Andrew C. R. 2007, *J. Mol. Biol.* 2007, 369, 852-862. The corresponding data are shown in Tables 24 and 25.

In one aspect, provided is an antibody that specifically binds to CD40, wherein said antibody comprises
 (i) a heavy chain variable region VH comprising an amino acid sequence of SEQ ID NO:171 and a light chain variable region VL comprising an amino acid sequence of SEQ ID NO: 175,
 (ii) a heavy chain variable region VH comprising an amino acid sequence of SEQ ID NO: 173 and a light chain variable region VL comprising an amino acid sequence of SEQ ID NO: 177,
 (iii) a heavy chain variable region VH comprising an amino acid sequence of SEQ ID NO:174 and a light chain variable region VL comprising an amino acid sequence of SEQ ID NO: 178,
 (iv) a heavy chain variable region VH comprising an amino acid sequence of SEQ ID NO:171 and a light chain variable region VL comprising an amino acid sequence of SEQ ID NO: 177,
 (v) a heavy chain variable region VH comprising an amino acid sequence of SEQ ID NO: 171 and a light chain variable region VL comprising an amino acid sequence of SEQ ID NO: 178,
 (vi) a heavy chain variable region VH comprising an amino acid sequence of SEQ ID NO: 173 and a light chain variable region VL comprising an amino acid sequence of SEQ ID NO: 175, or
 (vii) a heavy chain variable region VH comprising an amino acid sequence of SEQ ID NO: 173 and a light chain variable region VL comprising an amino acid sequence of SEQ ID NO: 178, or
 (viii) a heavy chain variable region VH comprising an amino acid sequence of SEQ ID NO: 174 and a light chain variable region VL comprising an amino acid sequence of SEQ ID NO: 175, or
 (viii) a heavy chain variable region VH comprising an amino acid sequence of SEQ ID NO: 174 and a light chain variable region VL comprising an amino acid sequence of SEQ ID NO: 177, or
 (ix) a heavy chain variable region VH comprising an amino acid sequence of SEQ ID NO:171 and a light chain variable region VL comprising an amino acid sequence of SEQ ID NO: 176, or
 (x) a heavy chain variable region VH comprising an amino acid sequence of SEQ ID NO: 172 and a light chain variable region VL comprising an amino acid sequence of SEQ ID NO: 175, or
 (xi) a heavy chain variable region VH comprising an amino acid sequence of SEQ ID NO: 172 and a light chain variable region VL comprising an amino acid sequence of SEQ ID NO: 176, or
 (xii) a heavy chain variable region VH comprising an amino acid sequence of SEQ ID NO: 172 and a light chain variable region VL comprising an amino acid sequence of SEQ ID NO: 177, or
 (xiii) a heavy chain variable region VH comprising an amino acid sequence of SEQ ID NO: 172 and a light chain variable region VL comprising an amino acid sequence of SEQ ID NO: 178, or
 (xiv) a heavy chain variable region VH comprising an amino acid sequence of SEQ ID NO: 173 and a light chain variable region VL comprising an amino acid sequence of SEQ ID NO: 176, or
 (xv) a heavy chain variable region VH comprising an amino acid sequence of SEQ ID NO: 174 and a light chain variable region VL comprising an amino acid sequence of SEQ ID NO: 176.

In another aspect, provided is an antibody that competes for binding with an antibody that specifically binds to CD40, wherein said antibody comprises any of the heavy chain variable region VH and a light chain variable region VL of (i) to (xv) as defined herein before.

In one aspect, provided is an antibody that competes for binding with an antibody that specifically binds to CD40, wherein said antibody comprises a heavy chain variable region VH comprising an amino acid sequence of SEQ ID NO: 171 and a light chain variable region VL comprising an amino acid sequence of SEQ ID NO:175.

In a further aspect, provided is an antibody that specifically binds to CD40, wherein said antibody comprises (i) a heavy chain variable region VH comprising an amino acid sequence of SEQ ID NO:179 and a light chain variable region VL comprising an amino acid sequence of SEQ ID NO: 185,
(ii) a heavy chain variable region VH comprising an amino acid sequence of SEQ ID NO:180 and a light chain variable region VL comprising an amino acid sequence of SEQ ID NO: 185,
(iii) a heavy chain variable region VH comprising an amino acid sequence of SEQ ID NO:181 and a light chain variable region VL comprising an amino acid sequence of SEQ ID NO: 185,
(iv) a heavy chain variable region VH comprising an amino acid sequence of SEQ ID NO:182 and a light chain variable region VL comprising an amino acid sequence of SEQ ID NO: 185,
(v) a heavy chain variable region VH comprising an amino acid sequence of SEQ ID NO: 179 and a light chain variable region VL comprising an amino acid sequence of SEQ ID NO: 186,
(vi) a heavy chain variable region VH comprising an amino acid sequence of SEQ ID NO:180 and a light chain variable region VL comprising an amino acid sequence of SEQ ID NO: 186, or
(vii) a heavy chain variable region VH comprising an amino acid sequence of SEQ ID NO: 181 and a light chain variable region VL comprising an amino acid sequence of SEQ ID NO: 186, or
(viii) a heavy chain variable region VH comprising an amino acid sequence of SEQ ID NO: 1182 and a light chain variable region VL comprising an amino acid sequence of SEQ ID NO: 186.

In another aspect, provided is an antibody that competes for binding with an antibody that specifically binds to CD40, wherein said antibody comprises any of the heavy chain variable region VH and a light chain variable region VL of (i) to (viii) as defined herein before.

In one aspect, provided is an antibody that competes for binding with an antibody that specifically binds to CD40, wherein said antibody comprises a heavy chain variable region VH comprising an amino acid sequence of SEQ ID NO: 179 and a light chain variable region VL comprising an amino acid sequence of SEQ ID NO: 185. In particular, provided is an antibody that specifically binds to CD40, wherein said antibody comprises a heavy chain variable region VH comprising an amino acid sequence of SEQ ID NO: 182 and a light chain variable region VL comprising an amino acid sequence of SEQ ID NO: 185.

Polynucleotides

The invention further provides isolated polynucleotides encoding a bispecific antigen binding molecule as described herein or a fragment thereof or polynucleotides encoding an antibody as described herein.

The isolated polynucleotides encoding bispecific antigen binding molecules of the invention may be expressed as a single polynucleotide that encodes the entire antigen binding molecule or as multiple (e.g., two or more) polynucleotides that are co-expressed. Polypeptides encoded by polynucleotides that are co-expressed may associate through, e.g., disulfide bonds or other means to form a functional antigen binding molecule. For example, the light chain portion of an immunoglobulin may be encoded by a separate polynucleotide from the heavy chain portion of the immunoglobulin. When co-expressed, the heavy chain polypeptides will associate with the light chain polypeptides to form the immunoglobulin.

In some aspects, the isolated polynucleotide encodes a polypeptide comprised in the bispecific molecule according to the invention as described herein.

In one aspect, the present invention is directed to an isolated polynucleotide encoding a bispecific antigen binding molecule, comprising (a) at least one antigen binding domain capable of specific binding to CD40, (b) at least one antigen binding domain capable of specific binding to a target cell antigen, and (c) a Fc domain composed of a first and a second subunit capable of stable association.

In certain embodiments the polynucleotide or nucleic acid is DNA. In other embodiments, a polynucleotide of the present invention is RNA, for example, in the form of messenger RNA (mRNA). RNA of the present invention may be single stranded or double stranded.

Recombinant Methods

Bispecific antigen binding molecules of the invention may be obtained, for example, by recombinant production. For recombinant production one or more polynucleotide encoding the bispecific antigen binding molecule or polypeptide fragments thereof are provided. The one or more polynucleotide encoding the bispecific antigen binding molecule are isolated and inserted into one or more vectors for further cloning and/or expression in a host cell. Such polynucleotide may be readily isolated and sequenced using conventional procedures. In one aspect of the invention, a vector, preferably an expression vector, comprising one or more of the polynucleotides of the invention is provided. Methods which are well known to those skilled in the art can be used to construct expression vectors containing the coding sequence of the bispecific antigen binding molecule (fragment) along with appropriate transcriptional/translational control signals. These methods include in vitro recombinant DNA techniques, synthetic techniques and in vivo recombination/genetic recombination. See, for example, the techniques described in Maniatis et al., MOLECULAR CLONING: A LABORATORY MANUAL. Cold Spring Harbor Laboratory. N. Y. (1989); and Ausubel et al., CURRENT PROTOCOLS IN MOLECULAR BIOLOGY. Greene Publishing Associates and Wiley Interscience. N.Y. (1989). The expression vector can be part of a plasmid, virus, or may be a nucleic acid fragment. The expression vector includes an expression cassette into which the polynucleotide encoding the bispecific antigen binding molecule or polypeptide fragments thereof (i.e. the coding region) is cloned in operable association with a promoter and/or other transcription or translation control elements. As used herein, a "coding region" is a portion of nucleic acid which consists of codons translated into amino acids. Although a "stop codon" (TAG. TGA, or TAA) is not translated into an amino acid, it may be considered to be part of a coding region, if present, but any flanking sequences, for example promoters, ribosome binding sites, transcriptional terminators, introns. 5' and 3' untranslated regions, and the like, are not part of a coding region. Two or more coding regions can be present in a single polynucleotide construct, e.g. on a single vector, or in separate polynucleotide constructs, e.g. on separate (different) vectors. Furthermore, any vector may contain a single coding region, or may comprise two or more coding regions, e.g. a vector of the present invention may encode one or more polypeptides, which are post- or co-translationally separated into the final proteins via proteolytic cleavage. In addition, a vector, polynucleotide, or nucleic acid of the invention may encode heterologous coding regions, either fused or unfused to a polynucleotide encoding the bispecific antigen binding molecule of the invention or polypeptide fragments thereof, or variants or derivatives thereof. Heterologous coding regions include without limitation specialized elements or motifs, such as a secretory signal peptide or a heterologous functional domain. An operable association is when a coding region for a gene product, e.g. a polypeptide, is associated with one or more regulatory sequences in such a way as to place expression of the gene product under the influence or control of the regulatory sequence(s). Two DNA fragments (such as a polypeptide coding region and a promoter associated therewith) are "operably associated" if induction of promoter function results in the transcription of mRNA encoding the desired gene product and if the nature of the linkage between the two DNA fragments does not interfere with the ability of the expression regulatory sequences to direct the expression of the gene product or interfere with the ability of the DNA template to be transcribed. Thus, a promoter region would be operably associated with a nucleic acid encoding a polypeptide if the promoter was capable of effecting transcription of that nucleic acid. The promoter may be a cell-specific promoter that directs substantial transcription of the DNA only in predetermined cells. Other transcription control elements, besides a promoter, for example enhancers, operators, repressors, and transcription termination signals, can be operably associated with the polynucleotide to direct cell-specific transcription.

Suitable promoters and other transcription control regions are disclosed herein. A variety of transcription control regions are known to those skilled in the art. These include, without limitation, transcription control regions, which function in vertebrate cells, such as, but not limited to, promoter and enhancer segments from cytomegaloviruses (e.g. the immediate early promoter, in conjunction with intron-A), simian virus 40 (e.g. the early promoter), and retroviruses (such as, e.g. Rous sarcoma virus). Other transcription control regions include those derived from vertebrate genes such as actin, heat shock protein, bovine growth hormone and rabbit â-globin, as well as other sequences capable of controlling gene expression in eukaryotic cells. Additional suitable transcription control regions include tissue-specific promoters and enhancers as well as inducible promoters (e.g. promoters inducible by tetracyclines), Similarly, a variety of translation control elements are known to those of ordinary skill in the art. These include, but are not limited to ribosome binding sites, translation initiation and termination codons, and elements derived from viral systems (particularly an internal ribosome entry site, or IRES, also referred to as a CITE sequence). The expression cassette may also include other features such as an origin of replication, and/or chromosome integration elements such as retroviral long terminal repeats (LTRs), or adeno-associated viral (AAV) inverted terminal repeats (ITRs).

Polynucleotide and nucleic acid coding regions of the present invention may be associated with additional coding regions which encode secretory or signal peptides, which direct the secretion of a polypeptide encoded by a polynucleotide of the present invention. For example, if secretion of the bispecific antigen binding molecule or polypeptide fragments thereof is desired. DNA encoding a signal sequence may be placed upstream of the nucleic acid encoding the bispecific antigen binding molecule of the invention or polypeptide fragments thereof. According to the signal hypothesis, proteins secreted by mammalian cells have a signal peptide or secretory leader sequence which is cleaved from the mature protein once export of the growing protein chain across the rough endoplasmic reticulum has been initiated. Those of ordinary skill in the art are aware that polypeptides secreted by vertebrate cells generally have a signal peptide fused to the N-terminus of the polypeptide, which is cleaved from the translated polypeptide to produce a secreted or "mature" form of the polypeptide. In certain embodiments, the native signal peptide, e.g. an immunoglobulin heavy chain or light chain signal peptide is used, or a functional derivative of that sequence that retains the ability to direct the secretion of the polypeptide that is operably associated with it. Alternatively, a heterologous mammalian signal peptide, or a functional derivative thereof, may be used. For example, the wild-type leader sequence may be substituted with the leader sequence of human tissue plasminogen activator (TPA) or mouse β-glucuronidase.

DNA encoding a short protein sequence that could be used to facilitate later purification (e.g. a histidine tag) or assist in labeling the fusion protein may be included within or at the ends of the polynucleotide encoding a bispecific antigen binding molecule of the invention or polypeptide fragments thereof.

In a further aspect of the invention, a host cell comprising one or more polynucleotides of the invention is provided. In certain aspects, a host cell comprising one or more vectors of the invention is provided. The polynucleotides and vectors may incorporate any of the features, singly or in combination, described herein in relation to polynucleotides and vectors, respectively. In one aspect, a host cell comprises (e.g. has been transformed or transfected with) a vector comprising a polynucleotide that encodes (part of) a bispecific antigen binding molecule of the invention of the invention. As used herein, the term "host cell" refers to any kind of cellular system which can be engineered to generate the fusion proteins of the invention or fragments thereof. Host cells suitable for replicating and for supporting expression of antigen binding molecules are well known in the art. Such cells may be transfected or transduced as appropriate with the particular expression vector and large quantities of vector containing cells can be grown for seeding large scale fermenters to obtain sufficient quantities of the antigen binding molecule for clinical applications. Suitable host cells include prokaryotic microorganisms, such as *E, coli*, or various eukaryotic cells, such as Chinese hamster ovary cells (CHO), insect cells, or the like. For example, polypeptides may be produced in bacteria in particular when glycosylation is not needed. After expression, the polypeptide may be isolated from the bacterial cell paste in a soluble fraction and can be further purified. In addition to prokaryotes, eukaryotic microbes such as filamentous fungi or yeast are suitable cloning or expression hosts for polypeptide-encoding vectors, including fungi and yeast strains whose glycosylation pathways have been "humanized", resulting in the production of a polypeptide with a partially or fully human glycosylation pattern. See Gerngross. Nat Biotech 22, 1409-1414 (2004), and Li et al., Nat Biotech 24, 210-215 (2006).

Suitable host cells for the expression of (glycosylated) polypeptides are also derived from multicellular organisms (invertebrates and vertebrates). Examples of invertebrate cells include plant and insect cells. Numerous baculoviral strains have been identified which may be used in conjunction with insect cells, particularly for transfection of *Spodoptera frugiperda* cells. Plant cell cultures can also be utilized as hosts. See e.g. U.S. Pat. Nos. 5,959,177, 6,040, 498, 6,420,548, 7,125,978, and 6,417,429 (describing PLANTIBODIES™ technology for producing antibodies in transgenic plants). Vertebrate cells may also be used as hosts. For example, mammalian cell lines that are adapted to grow in suspension may be useful. Other examples of useful mammalian host cell lines are monkey kidney CV1 line transformed by SV40 (COS-7); human embryonic kidney line (293 or 293T cells as described, e.g., in Graham et al., J Gen Virol 36, 59 (1977)), baby hamster kidney cells (BHK), mouse sertoli cells (TM4 cells as described, e.g., in Mather. Biol Reprod 23, 243-251 (1980)), monkey kidney cells (CV1). African green monkey kidney cells (VERO-76), human cervical carcinoma cells (HELA), canine kidney cells (MDCK), buffalo rat liver cells (BRL 3A), human lung cells (W138), human liver cells (Hep G2), mouse mammary tumor cells (MMT 060562), TRI cells (as described, e.g., in Mather et al., Annals N.Y. Acad Sci 383, 44-68 (1982)). MRC 5 cells, and FS4 cells. Other useful mammalian host cell lines include Chinese hamster ovary (CHO) cells, including dhfr-CHO cells (Urlaub et al., Proc Natl Acad Sci USA 77, 4216 (1980)); and myeloma cell lines such as YO. NS0. P3X63 and Sp2/0. For a review of certain mammalian host cell lines suitable for protein production, see. e.g., Yazaki and Wu. Methods in Molecular Biology. Vol. 248 (B.K.C. Lo, ed., Humana Press. Totowa. NJ), pp. 255-268 (2003). Host cells include cultured cells, e.g., mammalian cultured cells, yeast cells, insect cells, bacterial cells and plant cells, to name only a few, but also cells comprised within a transgenic animal, transgenic plant or cultured plant or animal tissue. In one embodiment, the host cell is a eukaryotic cell, preferably a mammalian cell, such as a Chinese Hamster Ovary (CHO) cell, a human embryonic kidney (HEK) cell or a lymphoid cell (e.g., YO. NS0. Sp20 cell), Standard technologies are known in the art to express foreign genes in these systems. Cells expressing a polypeptide comprising either the heavy or the light chain of an immunoglobulin, may be engineered so as to also express the other of the immunoglobulin chains such that the expressed product is an immunoglobulin that has both a heavy and a light chain.

In one aspect, a method of producing a bispecific antigen binding molecule of the invention or polypeptide fragments thereof is provided, wherein the method comprises culturing a host cell comprising polynucleotides encoding the bispecific antigen binding molecule of the invention or polypeptide fragments thereof, as provided herein, under conditions suitable for expression of the bispecific antigen binding molecule of the invention or polypeptide fragments thereof, and recovering the bispecific antigen binding molecule of the invention or polypeptide fragments thereof from the host cell (or host cell culture medium).

Bispecific molecules of the invention prepared as described herein may be purified by art-known techniques such as high performance liquid chromatography, ion exchange chromatography, gel electrophoresis, affinity chromatography, size exclusion chromatography, and the like. The actual conditions used to purify a particular protein will depend, in part, on factors such as net charge, hydrophobicity, hydrophilicity etc., and will be apparent to those having skill in the art. For affinity chromatography purification an antibody, ligand, receptor or antigen can be used to which the bispecific antigen binding molecule binds. For example, for affinity chromatography purification of fusion proteins of the invention, a matrix with protein A or protein G may be used. Sequential Protein A or G affinity chromatography and size exclusion chromatography can be used to isolate an antigen binding molecule essentially as described in the examples. The purity of the bispecific antigen binding molecule or fragments thereof can be determined by any of a variety of well-known analytical methods including gel electrophoresis, high pressure liquid chromatography, and the like. For example, the bispecific antigen binding molecules expressed as described in the Examples were shown to be intact and properly assembled as demonstrated by reducing and non-reducing SDS-PAGE.

Assays

The antigen binding molecules provided herein may be characterized for their binding properties and/or biological activity by various assays known in the art. In particular, they are characterized by the assays described in more detail in the examples.

1. Binding Assay

Binding of the bispecific antigen binding molecule provided herein to the corresponding target expressing cells may be evaluated for example by using a murine fibroblast cell line expressing human Fibroblast Activation Protein (FAP) and flow cytometry (FACS) analysis. Binding of the bispecific antigen binding molecules provided herein to CD40 may be determined by using Raji cells as described in Example 4.2.8.

2. Activity Assays

Bispecific antigen binding molecules of the invention are tested for biological activity. Biological activity may include efficacy and specificity of the bispecific antigen binding molecules. Efficacy and specificity are demonstrated by assays showing agonistic signaling through the CD40 receptor upon binding of the target antigen. Furthermore in vitro T cell priming assays are conducted using dendritic cells (DCs) that have been incubated with the bispecific antigen binding molecules.

Pharmaceutical Compositions, Formulations and Routes of Administration

In a further aspect, the invention provides pharmaceutical compositions comprising any of the bispecific antigen binding molecules provided herein, e.g., for use in any of the below therapeutic methods. In one embodiment, a pharmaceutical composition comprises any of the bispecific antigen binding molecules provided herein and at least one pharmaceutically acceptable excipient. In another embodiment, a pharmaceutical composition comprises any of the bispecific antigen binding molecules provided herein and at least one additional therapeutic agent, e.g., as described below:

Pharmaceutical compositions of the present invention comprise a therapeutically effective amount of one or more bispecific antigen binding molecules dissolved or dispersed in a pharmaceutically acceptable excipient. The phrases "pharmaceutical or pharmacologically acceptable" refers to molecular entities and compositions that are generally non-toxic to recipients at the dosages and concentrations employed, i.e. do not produce an adverse, allergic or other untoward reaction when administered to an animal, such as, for example, a human, as appropriate. The preparation of a pharmaceutical composition that contains at least one bispecific antigen binding molecule according to the invention and optionally an additional active ingredient will be known to those of skill in the art in light of the present disclosure, as exemplified by Remington's Pharmaceutical Sciences. 18th Ed. Mack Printing Company. 1990, incorporated herein by reference. In particular, the compositions are lyophilized formulations or aqueous solutions. As used herein. "pharmaceutically acceptable excipient" includes any and all solvents, buffers, dispersion media, coatings, surfactants, antioxidants, preservatives (e.g. antibacterial agents, antifungal agents), isotonic agents, salts, stabilizers and combinations thereof, as would be known to one of ordinary skill in the art.

Parenteral compositions include those designed for administration by injection, e.g. subcutaneous, intradermal, intralesional, intravenous, intraarterial intramuscular, intrathecal or intraperitoneal injection. For injection, the bispecific antigen binding molecules of the invention may be formulated in aqueous solutions, preferably in physiologically compatible buffers such as Hanks' solution. Ringer's solution, or physiological saline buffer. The solution may contain formulatory agents such as suspending, stabilizing and/or dispersing agents. Alternatively, the bispecific antigen binding molecules may be in powder form for constitution with a suitable vehicle, e.g., sterile pyrogen-free water, before use. Sterile injectable solutions are prepared by incorporating the antigen binding molecules of the invention in the required amount in the appropriate solvent with various of the other ingredients enumerated below, as required. Sterility may be readily accomplished, e.g., by filtration through sterile filtration membranes. Generally, dispersions are prepared by incorporating the various sterilized active ingredients into a sterile vehicle which contains the basic dispersion medium and/or the other ingredients. In the case of sterile powders for the preparation of sterile injectable solutions, suspensions or emulsion, the preferred methods of preparation are vacuum-drying or freeze-drying techniques which yield a powder of the active ingredient plus any additional desired ingredient from a previously sterile-filtered liquid medium thereof. The liquid medium should be suitably buffered if necessary and the liquid diluent first rendered isotonic prior to injection with sufficient saline or glucose. The composition must be stable under the conditions of manufacture and storage, and preserved against the contaminating action of microorganisms, such as bacteria and fungi. It will be appreciated that endotoxin contamination should be kept minimally at a safe level, for example, less than 0.5 ng/mg protein. Suitable pharmaceutically acceptable excipients include, but are not limited to: buffers such as phosphate, citrate, and other organic acids; antioxidants including ascorbic acid and methionine; preservatives (such as octadecyldimethylbenzyl ammonium chloride; hexamethonium chloride; benzalkonium chloride; benzethonium chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) polypeptides; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrins; chelating agents such as EDTA: sugars such as sucrose, mannitol, trehalose or sorbitol; salt-forming counter-ions such as sodium: metal complexes (e.g. Zn-protein complexes); and/or non-ionic surfactants such as polyethylene glycol (PEG). Aqueous injection suspensions may contain compounds which increase the viscosity of the suspension, such as sodium carboxymethyl cellulose, sorbitol, dextran, or the like. Optionally, the suspension may also contain suitable stabilizers or agents which increase the solubility of the compounds to allow for the preparation of highly concentrated solutions. Additionally, suspensions of the active compounds may be prepared as appropriate oily injection suspensions. Suitable lipophilic solvents or vehicles include fatty oils such as sesame oil, or synthetic fatty acid esters, such as ethyl cleats or triglycerides, or liposomes.

Active ingredients may be entrapped in microcapsules prepared, for example, by coacervation techniques or by interfacial polymerization, for example, hydroxymethylcellulose or gelatin-microcapsules and poly-(methylmethacylate) microcapsules, respectively, in colloidal drug delivery systems (for example, liposomes, albumin microspheres, microemulsions, nano-particles and nanocapsules) or in macroemulsions. Such techniques are disclosed in Remington's Pharmaceutical Sciences (18th Ed. Mack Printing Company. 1990), Sustained-release preparations may be prepared. Suitable examples of sustained-release preparations include semipermeable matrices of solid hydrophobic polymers containing the polypeptide, which matrices are in the form of shaped articles, e.g. films, or microcapsules. In particular embodiments, prolonged absorption of an injectable composition can be brought about by the use in the compositions of agents delaying absorption, such as, for example, aluminum monostearate, gelatin or combinations thereof.

Exemplary pharmaceutically acceptable excipients herein further include interstitial drug dispersion agents such as soluble neutral-active hyaluronidase glycoproteins (sHASEGP), for example, human soluble PH-20 hyaluronidase glycoproteins, such as rHuPH20 (HYLENEX®, Baxter International, Inc.). Certain exemplary sHASEGPs and methods of use, including rHuPH20, are described in US Patent Publication Nos. 2005/0260186 and 2006/0104968. In one aspect, a sHASEGP is combined with one or more additional glycosaminoglycanases such as chondroitinases.

Exemplary lyophilized antibody formulations are described in U.S. Pat. No. 6,267,958. Aqueous antibody formulations include those described in U.S. Pat. No. 6,171, 586 and WO2006/044908, the latter formulations including a histidine-acetate buffer.

In addition to the compositions described previously, the antigen binding molecules may also be formulated as a depot preparation. Such long acting formulations may be administered by implantation (for example subcutaneously or intramuscularly) or by intramuscular injection. Thus, for example, the fusion proteins may be formulated with suitable polymeric or hydrophobic materials (for example as emulsion in an acceptable oil) or ion exchange resins, or as sparingly soluble derivatives, for example, as a sparingly soluble salt.

Pharmaceutical compositions comprising the bispecific antigen binding molecules of the invention may be manufactured by means of conventional mixing, dissolving, emulsifying, encapsulating, entrapping or lyophilizing processes. Pharmaceutical compositions may be formulated in conventional manner using one or more physiologically acceptable carriers, diluents, excipients or auxiliaries which facilitate processing of the proteins into preparations that can be used pharmaceutically. Proper formulation is dependent upon the route of administration chosen.

The bispecific antigen binding molecules may be formulated into a composition in a free acid or base, neutral or salt form. Pharmaceutically acceptable salts are salts that substantially retain the biological activity of the free acid or base. These include the acid addition salts, e.g. those formed with the free amino groups of a proteinaceous composition, or which are formed with inorganic acids such as for example, hydrochloric or phosphoric acids, or such organic acids as acetic, oxalic, tartaric or mandelic acid. Salts formed with the free carboxyl groups can also be derived from inorganic bases such as for example, sodium, potassium, ammonium, calcium or ferric hydroxides; or such organic bases as isopropylamine, trimethylamine, histidine or procaine. Pharmaceutical salts tend to be more soluble in aqueous and other protic solvents than are the corresponding free base forms.

The composition herein may also contain more than one active ingredients as necessary for the particular indication being treated, preferably those with complementary activities that do not adversely affect each other. Such active ingredients are suitably present in combination in amounts that are effective for the purpose intended.

The formulations to be used for in vivo administration are generally sterile. Sterility may be readily accomplished, e.g., by filtration through sterile filtration membranes.

Therapeutic Methods and Compositions

Any of the bispecific antigen binding molecules provided herein may be used in therapeutic methods. For use in therapeutic methods, bispecific antigen binding molecules of the invention can be formulated, dosed, and administered in a fashion consistent with good medical practice. Factors for consideration in this context include the particular disorder being treated, the particular mammal being treated, the clinical condition of the individual patient, the cause of the disorder, the site of delivery of the agent, the method of administration, the scheduling of administration, and other factors known to medical practitioners.

In one aspect, bispecific antigen binding molecules of the invention for use as a medicament are provided.

In further aspects, bispecific antigen binding molecules of the invention for use (i) in inducing immune stimulation by CD40+ antigen-presenting cells (APCs), (ii) in stimulating tumor-specific T cell response, (iii) in causing apoptosis of tumor cells, (iv) in the treatment of cancer, (v) in delaying progression of cancer, (vi) in prolonging the survival of a patient suffering from cancer, (vii) in the treatment of infections are provided. In a particular aspect, bispecific antigen binding molecules of the invention for use in treating a disease, in particular for use in the treatment of cancer, are provided.

In certain aspects, bispecific antigen binding molecules of the invention for use in a method of treatment are provided. In one aspect, the invention provides a bispecific antigen binding molecule as described herein for use in the treatment of a disease in an individual in need thereof. In certain aspects, the invention provides a bispecific antigen binding molecule for use in a method of treating an individual having a disease comprising administering to the individual a therapeutically effective amount of the bispecific antigen binding molecule. In certain aspects the disease to be treated is cancer. The subject, patient, or "individual" in need of treatment is typically a mammal, more specifically a human.

In one aspect, provided is a method for i) inducing immune stimulation by CD40+ antigen-presenting cells (APCs), (ii) stimulating tumor-specific T cell response, (iii) causing apoptosis of tumor cells, (iv) treating of cancer, (v) delaying progression of cancer, (vi) prolonging the survival of a patient suffering from cancer, or (vii) treating of infections, wherein the method comprises administering a therapeutically effective amount of the bispecific antigen binding molecule of the invention to an individual in need thereof.

In a further aspect, the invention provides for the use of the bispecific antigen binding molecule of the invention in the manufacture or preparation of a medicament for the treatment of a disease in an individual in need thereof. In one aspect, the medicament is for use in a method of treating a disease comprising administering to an individual having the disease a therapeutically effective amount of the medicament. In certain aspects, the disease to be treated is a proliferative disorder, particularly cancer. Examples of cancers include, but are not limited to, bladder cancer, brain cancer, head and neck cancer, pancreatic cancer, lung cancer, breast cancer, ovarian cancer, uterine cancer, cervical cancer, endometrial cancer, esophageal cancer, colon cancer, colorectal cancer, rectal cancer, gastric cancer, prostate cancer, blood cancer, skin cancer, squamous cell carcinoma, bone cancer, and kidney cancer. Other examples of cancer include carcinoma, lymphoma (e.g., Hodgkin's and non-Hodgkin's lymphoma), blastoma, sarcoma, and leukemia. Other cell proliferation disorders that can be treated using the bispecific antigen binding molecule or antibody of the invention include, but are not limited to neoplasms located in the: abdomen, bone, breast, digestive system, liver, pancreas, peritoneum, endocrine glands (adrenal, parathyroid, pituitary, testicles, ovary, thymus, thyroid), eye, head and neck, nervous system (central and peripheral), lymphatic system, pelvic, skin, soft tissue, spleen, thoracic region, and urogenital system. Also included are pre-cancerous conditions or lesions and cancer metastases. In certain embodiments the cancer is chosen from the group consisting of renal cell cancer, skin cancer, lung cancer, colorectal cancer, breast cancer, brain cancer, head and neck cancer. A skilled artisan readily recognizes that in many cases the bispecific antigen binding molecule or antibody of the invention may not provide a cure but may provide a benefit. In some aspects, a physiological change having some benefit is also considered therapeutically beneficial. Thus, in some aspects, an amount of the bispecific antigen binding molecule or antibody of the invention that provides a physiological change is considered an "effective amount" or a "therapeutically effective amount".

For the prevention or treatment of disease, the appropriate dosage of a bispecific antigen binding molecule of the invention (when used alone or in combination with one or more other additional therapeutic agents) will depend on the type of disease to be treated, the route of administration, the body weight of the patient, the specific molecule, the severity and course of the disease, whether the bispecific antigen binding molecule of the invention is administered for preventive or therapeutic purposes, previous or concurrent therapeutic interventions, the patient's clinical history and response to the bispecific antigen binding molecule, and the discretion of the attending physician. The practitioner responsible for administration will, in any event, determine the concentration of active ingredient(s) in a composition and appropriate dose(s) for the individual subject. Various dosing schedules including but not limited to single or multiple administrations over various time-points, bolus administration, and pulse infusion are contemplated herein.

The bispecific antigen binding molecule of the invention is suitably administered to the patient at one time or over a series of treatments. Depending on the type and severity of the disease, about 1 µg/kg to 15 mg/kg (e.g. 0.1 mg/kg-10 mg/kg) of the bispecific antigen binding molecule can be an initial candidate dosage for administration to the patient, whether, for example, by one or more separate administrations, or by continuous infusion. One typical daily dosage might range from about 1 µg/kg to 100 mg/kg or more, depending on the factors mentioned above. For repeated administrations over several days or longer, depending on the condition, the treatment would generally be sustained until a desired suppression of disease symptoms occurs. One exemplary dosage of the bispecific antigen binding molecule of the invention would be in the range from about 0.005 mg/kg to about 10 mg/kg. In other examples, a dose may also comprise from about 1 µg/kg body weight, about 5 µg/kg body weight, about 10 µg/kg body weight, about 50 µg/kg body weight, about 100 µg/kg body weight, about 200 µg/kg body weight, about 350 µg/kg body weight, about 500 µg/kg body weight, about 1 mg/kg body weight, about 5 mg/kg body weight, about 10 mg/kg body weight, about 50 mg/kg body weight, about 100 mg/kg body weight, about 200 mg/kg body weight, about 350 mg/kg body weight, about 500 mg/kg body weight, to about 1000 mg/kg body weight or more per administration, and any range derivable therein. In examples of a derivable range from the numbers listed herein, a range of about 0.1 mg/kg body weight to about 20 mg/kg body weight, about 5 µg/kg body weight to about 1 mg/kg body weight etc., can be administered, based on the numbers described above. Thus, one or more doses of about 0.5 mg/kg. 2.0 mg/kg. 5.0 mg/kg or 10 mg/kg (or any combination thereof) may be administered to the patient. Such doses may be administered intermittently, e.g. every week or every three weeks (e.g. such that the patient receives from about two to about twenty, or e.g. about six doses of the fusion protein). In a particular aspect, the bispecific antigen binding molecule will be administered every three weeks. An initial higher loading dose, followed by one or more lower doses may be administered. However, other dosage regimens may be useful. The progress of this therapy is easily monitored by conventional techniques and assays.

The bispecific antigen binding molecule of the invention will generally be used in an amount effective to achieve the intended purpose. For use to treat or prevent a disease condition, the bispecific antigen binding molecule of the invention, or pharmaceutical compositions thereof, are administered or applied in a therapeutically effective amount. Determination of a therapeutically effective amount is well within the capabilities of those skilled in the art, especially in light of the detailed disclosure provided herein. For systemic administration, a therapeutically effective dose can be estimated initially from in vitro assays, such as cell culture assays. A dose can then be formulated in animal models to achieve a circulating concentration range that includes the $IC_{50}$ as determined in cell culture. Such information can be used to more accurately determine useful doses in humans. Initial dosages can also be estimated from in vivo data, e.g., animal models, using techniques that are well known in the art. One having ordinary skill in the art could readily optimize administration to humans based on animal data.

Dosage amount and interval may be adjusted individually to provide plasma levels of the bispecific antigen binding molecule of the invention which are sufficient to maintain therapeutic effect. Usual patient dosages for administration by injection range from about 0.1 to 50 mg/kg/day, typically from about 0.1 to 1 mg/kg/day. Therapeutically effective plasma levels may be achieved by administering multiple doses each day. Levels in plasma may be measured, for example, by HPLC. In cases of local administration or selective uptake, the effective local concentration of the bispecific antigen binding molecule or antibody of the invention may not be related to plasma concentration. One skilled in the art will be able to optimize therapeutically effective local dosages without undue experimentation.

A therapeutically effective dose of the bispecific antigen binding molecule of the invention described herein will generally provide therapeutic benefit without causing substantial toxicity. Toxicity and therapeutic efficacy of a fusion protein can be determined by standard pharmaceutical procedures in cell culture or experimental animals. Cell culture assays and animal studies can be used to determine the $LD_{50}$ (the dose lethal to 50% of a population) and the $ED_{50}$ (the dose therapeutically effective in 50% of a population). The dose ratio between toxic and therapeutic effects is the therapeutic index, which can be expressed as the ratio $LD_{50}/ED_{50}$. Bispecific antigen binding molecules that exhibit large therapeutic indices are preferred. In one aspect, the bispecific antigen binding molecule or antibody of the invention exhibits a high therapeutic index. The data obtained from cell culture assays and animal studies can be used in formulating a range of dosages suitable for use in humans. The dosage lies preferably within a range of circulating concentrations that include the $ED_{50}$ with little or no toxicity. The dosage may vary within this range depending upon a variety of factors, e.g., the dosage form employed, the route of administration utilized, the condition of the subject, and the like. The exact formulation, route of administration and dosage can be chosen by the individual physician in view of the patient's condition (see, e.g., Fingl et al., 1975, in: The Pharmacological Basis of Therapeutics. Ch. I, p. 1, incorporated herein by reference in its entirety).

The attending physician for patients treated with fusion proteins of the invention would know how and when to terminate, interrupt, or adjust administration due to toxicity, organ dysfunction, and the like. Conversely, the attending physician would also know to adjust treatment to higher levels if the clinical response were not adequate (precluding toxicity). The magnitude of an administered dose in the management of the disorder of interest will vary with the severity of the condition to be treated, with the route of administration, and the like. The severity of the condition may, for example, be evaluated, in part, by standard prognostic evaluation methods. Further, the dose and perhaps dose frequency will also vary according to the age, body weight, and response of the individual patient.

Other Agents and Treatments

The bispecific antigen binding molecule of the invention may be administered in combination with one or more other agents in therapy. For instance, the bispecific antigen binding molecule or antibody of the invention of the invention may be co-administered with at least one additional therapeutic agent. The term "therapeutic agent" encompasses any agent that can be administered for treating a symptom or disease in an individual in need of such treatment. Such additional therapeutic agent may comprise any active ingredients suitable for the particular indication being treated, preferably those with complementary activities that do not adversely affect each other. In certain embodiments, an additional therapeutic agent is another anti-cancer agent, for example a microtubule disruptor, an antimetabolite, a topoisomerase inhibitor, a DNA intercalator, an alkylating agent, a hormonal therapy, a kinase inhibitor, a receptor antagonist, an activator of tumor cell apoptosis, or an antiangiogenic agent. In certain aspects, an additional therapeutic agent is an immunomodulatory agent, a cytostatic agent, an inhibitor of cell adhesion, a cytotoxic or cytostatic agent, an activator of cell apoptosis, or an agent that increases the sensitivity of cells to apoptotic inducers.

Thus, provided are bispecific antigen binding molecules of the invention or pharmaceutical compositions comprising them for use in the treatment of cancer, wherein the bispecific antigen binding molecule is administered in combination with a chemotherapeutic agent, radiation and/or other agents for use in cancer immunotherapy.

Such other agents are suitably present in combination in amounts that are effective for the purpose intended. The effective amount of such other agents depends on the amount of fusion protein used, the type of disorder or treatment, and other factors discussed above. The bispecific antigen binding molecule or antibody of the invention are generally used in the same dosages and with administration routes as described herein, or about from 1 to 99% of the dosages described herein, or in any dosage and by any route that is empirically/clinically determined to be appropriate.

Such combination therapies noted above encompass combined administration (where two or more therapeutic agents are included in the same or separate compositions), and separate administration, in which case, administration of the bispecific antigen binding molecule or antibody of the invention can occur prior to, simultaneously, and/or following, administration of the additional therapeutic agent and/or adjuvant.

Articles of Manufacture

In another aspect of the invention, an article of manufacture containing materials useful for the treatment, prevention and/or diagnosis of the disorders described above is provided. The article of manufacture comprises a container and a label or package insert on or associated with the container. Suitable containers include, for example, bottles, vials, syringes, IV solution bags, etc. The containers may be formed from a variety of materials such as glass or plastic. The container holds a composition which is by itself or combined with another composition effective for treating, preventing and/or diagnosing the condition and may have a sterile access port (for example the container may be an intravenous solution bag or a vial having a stopper that is pierceable by a hypodermic injection needle). At least one active agent in the composition is a bispecific antigen binding molecule of the invention.

The label or package insert indicates that the composition is used for treating the condition of choice. Moreover, the article of manufacture may comprise (a) a first container with a composition contained therein, wherein the composition comprises a bispecific antigen binding molecule of the invention; and (b) a second container with a composition contained therein, wherein the composition comprises a further cytotoxic or otherwise therapeutic agent. The article of manufacture in this embodiment of the invention may further comprise a package insert indicating that the compositions can be used to treat a particular condition.

Alternatively, or additionally, the article of manufacture may further comprise a second (or third) container comprising a pharmaceutically-acceptable buffer, such as bacteriostatic water for injection (BWFI), phosphate-buffered saline, Ringer's solution and dextrose solution. It may further include other materials desirable from a commercial and user standpoint, including other buffers, diluents, filters, needles, and syringes.

TABLE C (Sequences):

| SEQ ID NO: | Name | Sequence |
|---|---|---|
| 1 | hu CD40 | UniProt no. P25942, version 200<br>MVRLPLQCVL WGCLLTAVHP EPPTACREKQ<br>YLINSQCCSL CQPGQKLVSD CTEFTETECL<br>PCGESEFLDT WNRETHCHQH KYCDPNLGLR<br>VQQKGTSETD TICTCEEGWH CTSEACESCV<br>LHRSCSPGFG VKQIATGVSD TICEPCPVGF<br>FSNVSSAFEK CHPWTSCETK DLVVQQAGTN<br>KTDVVCGPQD RLRALVVIPI IFGILFAILL<br>VLVFIKKVAK KPTNKAPHPK QEPQEINFPD<br>DLPGSNTAAP VQETLHGCQP VTQEDGKESR<br>ISVQERQ |
| 2 | hu FAP | UniProt no. Q12884, version 168<br>MKTWVKIVFG VATSAVLALL VMCIVLRPSR<br>VHNSEENTMR ALTLKDILNG TFSYKTFFPN<br>WISGQEYLHQ SADNNIVLYN IETGQSYTIL<br>SNRTMKSVNA SNYGLSPDRQ FVYLESDYSK<br>LWRYSYTATY YIYDLSNGEF VRGNELPRPI<br>QYLCWSPVGS KLAYVYQNNI YLKQRPGDPP<br>FQITFNGREN KIFNGIPDWV YEEEMLATKY<br>ALWWSPNGKF LAYAEFNDTD IPVIAYSYYG<br>DEQYPRTINI PYPKAGAKNP VVRIFIIDTT<br>YPAYVGPQEV PVPAMIASSD YYFSWLTWVT<br>DERVCLQWLK RVQNVSVLSI CDFREDWQTW<br>DCPKTQEHIE ESRTGWAGGF FVSTPVFSYD<br>AISYYKIFSD KDGYKHIHYI KDTVENAIQI<br>TSGKWEAINI FRVTQDSLFY SSNEFEEYPG<br>RRNIYRISIG SYPPSKKCVT CHLRKERCQY<br>YTASFSDYAK YYALVCYGPG IPISTLHDGR<br>TDQEIKILEE NKELENALKN IQLPKEEIKK<br>LEVDEITLWY KMILPPQFDR SKKYPLLIQV<br>YGGPCSQSVR SVFAVNWISY LASKEGMVIA<br>LVDGRGTAFQ GDKLLYAVYR KLGVYEVEDQ<br>ITAVRKFIEM GFIDEKRIAI WGWSYGGYVS<br>SLALASGTGL FKCGIAVAPV SSWEYYASVY<br>TERFMGLPTK DDNLEHYKNS TVMARAEYFR<br>NVDYLLIHGT ADDNVHFQNS AQIAKALVNA<br>QVDFQAMWYS DQNHGLSGLS TNHLYTHMTH<br>FLKQCFSLSD |
| 3 | FAP (28H1) CDR-H1 | SHAMS |
| 4 | FAP (28H1) CDR-H2 | AIWASGEQYYADSVKG |
| 5 | FAP (28H1) CDR-H3 | GWLGNFDY |
| 6 | FAP (28H1) CDR-L1 | RASQSVSRSYLA |

TABLE C-continued (Sequences):

| SEQ ID NO: | Name | Sequence |
|---|---|---|
| 7 | FAP (28H1) CDR-L2 | GASTRAT |
| 8 | FAP (28H1) CDR-L3 | QQGQVIPPT |
| 9 | FAP(28H1) VH | EVQLLESGGGLVQPGGSLRLSCAASGFTFSSHAMS WVRQAPGKGLEWVSAIWASGEQYYADSVKGRFTIS RDNSKNTLYLQMNSLRAEDTAVYYCAKGWLGNFDY WGQGTLVTVSS |
| 10 | FAP(28H1) VL | EIVLTQSPGTLSLSPGERATLSCRASQSVSRSYLA WYQQKPGQAPRLLIGASTRATGIPDRFSGSGSGT DFTLTISRLEPEDFAVYYCQQGQVIPPTFGQGTKV EIK |
| 11 | FAP(4B9) CDR-H1 | SYAMS |
| 12 | FAP(4B9) CDR-H2 | AIIGSGASTYYADSVKG |
| 13 | FAP(4B9) CDR-H3 | GWFGGFNY |
| 14 | FAP(4B9) CDR-L1 | RASQSVTSSYLA |
| 15 | FAP(4B9) CDR-L2 | VGSRRAT |
| 16 | FAP(4B9) CDR-L3 | QQGIMLPPT |
| 17 | FAP(4B9) VH | EVQLLESGGGLVQPGGSLRLSCAASGFTFSSYAMS WVRQAPGKGLEWVSAIIGSGASTYYADSVKGRFTI SRDNSKNTLYLQMNSLRAEDTAVYYCAKGWFGGFN YWGQGTLVTVSS |
| 18 | FAP(4B9) VL | EIVLTQSPGTLSLSPGERATLSCRASQSVTSSYLA WYQQKPGQAPRLLINVGSRRATGIPDRFSGSGSGT DFTLTISRLEPEDFAVYYCQQGIMLPPTFGQGTKV EIK |
| 19 | hu CD40 CDR-H1 | GYYIH |
| 20 | hu CD40 CDR-H2 | RVIPNAGGTSYNQKFKG |
| 21 | hu CD40 CDR-H3 | EGIYW |
| 22 | hu CD40 CDR-L1 | RSSQSLVHSNGNTFLH |
| 23 | hu CD40 CDR-L2 | TVSNRFS |
| 24 | hu CD40 CDR-L3 | SQTTHVPWT |
| 25 | hu CD40 VH | EVQLVESGGGLVQPGGSLRLSCAASGYSFTGYYIH WVRQAPGKGLEWVARVIPNAGGTSYNQKFKGRFTL SVDNSKNTAYLQMNSLRAEDTAVYYCAREGIYWWG QGTLVTVSS |
| 26 | hu CD40 VL | DIQMTQSPSSLSASVGDRVTITCRSSQSLVHSNGN TFLHWYQQKPGKAPKLLIYTVSNRFSGVPSRFSGS GSGTDFTLTISSLQPEDFATYFCSQTTHVPWTFGQ GTKVEIK |
| 27 | mu CD40 CDR-H1 | DYYMA |
| 28 | mu CD40 CDR-H2 | SISYDGSSTYYRDSVKG |
| 29 | mu CD40 CDR-H3 | HSSYFDY |
| 30 | mu CD40 CDR-L1 | ASDSVSTLMH |
| 31 | mu CD40 CDR-L2 | LASHLES |
| 32 | mu CD40 CDR-L3 | QQSWNDPWT |
| 33 | mu CD40 VH | EVQLVESDGGLVQPGRSLKLPCAASGFTFSDYYMA WVRQAPTKGLEWVASISYDGSSTYYRDSVKGRFTI SRDNAKSTLYLQMDSLRSEDTATYYCGRHSSYFDY WGQGVMVTVSS |

TABLE C-continued (Sequences):

| SEQ ID NO: | Name | Sequence |
|---|---|---|
| 34 | mu CD40 VL | DTVLTQSPALAVSPGERVTISCRASDSVSTLMHWYQQKPGQQPKLLIYLASHLESGVPARFSGSGSGTDFTLTIDPVEADDTATYYCQQSWNDPWTFGGGTKLELK |
| 35 | hu CD40 CDR-H1 long | GYSFTGYYIH |
| 36 | hu CD40 CDR-H2 (hVH_1, hVH_2) | RVIPNNGGTSYNQKFKG |
| 37 | hu CD40 CDR-H2 (hVH_3) | RVIPNAGGTSYNQKFKG |
| 38 | hu CD40 CDR-H2 (hVH_4) | RVIPQAGGTSYNQKFKG |
| 39 | hu CD40 CDR-H2 (hVH_5) | RVIPNNGGTSYNQKFQG |
| 40 | hu CD40 CDR-H2 (hVH_6) | RVIPNNGGTSYAQKFKG |
| 41 | hu CD40 CDR-H2 (hVH_7) | RVIPNNGGTSYAQKFQG |
| 42 | hu CD40 CDR-H2 (hVH_5_N288A) | RVIPNAGGTSYNQKFQG |
| 43 | hu CD40 CDR-H2 (hVH_6_N288A) | RVIPNAGGTSYAQKFKG |
| 44 | hu CD40 CDR-H2 (hVH_7_N288A) | RVIPNAGGTSYAQKFQG |
| 45 | hu CD40 hVH_1 | see Table 14 |
| 46 | hu CD40 hVH_2 | see Table 14 |
| 47 | hu CD40 hVH_3 | see Table 14 |
| 48 | hu CD40 hVH_4 | see Table 14 |
| 49 | hu CD40 hVH_5 | see Table 14 |
| 50 | hu CD40 hVH_6 | see Table 14 |
| 51 | hu CD40 hVH_7 | see Table 14 |
| 52 | hu CD40 hVH_2_N288A | see Table 14 |
| 53 | hu CD40 hVH_5_N288A | see Table 14 |
| 54 | hu CD40 hVH_6_N288A | see Table 14 |
| 55 | hu CD40 hVH_7_N288A | see Table 14 |
| 56 | hu CD40 hVK_1 | see Table 15 |
| 57 | hu CD40 hVK_2 | see Table 15 |
| 58 | hu CD40 hVK_3 | see Table 15 |
| 59 | hu CD40 hVK_4 | see Table 15 |
| 60 | hu CD40 hVK_5 | see Table 15 |
| 61 | hu CD40 hVK_6 | see Table 15 |
| 62 | hu CD40 hVK_7 | see Table 15 |
| 63 | hu CD40 hVK_8 | see Table 15 |
| 64 | hu CD40 hVK_9 | see Table 15 |
| 65 | DP47-CDR H1 | SYAMS |
| 66 | DP47-CDR H2 | AISGSGGSTYYADSVKG |
| 67 | DP47-CDR H3 | GSGFDY |

TABLE C-continued

(Sequences):

| SEQ ID NO: | Name | Sequence |
|---|---|---|
| 68 | DP47-CDR L1 | RASQSVSSSYLA |
| 69 | DP47-CDR L2 | GASSRAT |
| 70 | DP47-CDR L3 | QQYGSSPLT |
| 71 | DP47 VH | EVQLLESGGGLVQPGGSLRLSCAASGFTFSSYAMS WVRQAPGKGLEWVSAISGSGGSTYYADSVKGRFTI SRDNSKNTLYLQMNSLRAEDTAVYYCAKGSGFDYW GQGTLVTVSS |
| 72 | DP47 VL | EIVLTQSPGTLSLSPGERATLSCRASQSVSSSYLA WYQQKPGQAPRLLIYGASSRATGIPDRFSGSGSGT DFTLTISRLEPEDFAVYYCQQYGSSPLTFGQGTKV EIK |
| 73 | hu CD40 VH (nucleotide sequence) | see Table 2 |
| 74 | hu CD40 VL (nucleotide sequence) | see Table 2 |
| 75 | FAP 28H1 VH (nucleotide sequence) | see Table 2 |
| 76 | FAP 28H1 VL (nucleotide sequence) | see Table 2 |
| 77 | DP47 VH (nucleotide sequence) | see Table 2 |
| 78 | DP47 VL (nucleotide sequence) | see Table 2 |
| 79 | mu CD40 VH (nucleotide sequence) | see Table 2 |
| 80 | mu CD40 VL (nucleotide sequence) | see Table 2 |
| 81 | CD40 IgG heavy chain | see Table 3 |
| 82 | CD40 light chain | see Table 3 |
| 83 | CD40 VHCH1-CD40 VHCH1-Fcknob_PGLALA-28H1 VH | see Table 3 |
| 84 | CD40 VHCH1-CD40 VHCH1-Fchole_PGLALA-28H1 VL | see Table 3 |
| 85 | CD40 VHCH1-CD40 VHCH1-Fc_PGLALA-28H1 VLCH1 EE | see Table 3 |
| 86 | CD40 light chain RK | see Table 3 |
| 87 | 28H1 VHCL | see Table 3 |
| 88 | huCD40_Fchole_PGLALA_ 28H1 VL | see Table 3 |
| 89 | huCD40_Fcknob_PGLALA_ 28H1 VH | see Table 3 |
| 90 | huCD40-Fc_PGLALA_28H1_VLCH1 EE | see Table 3 |
| 91 | CD40 VHCH1-CD40 VHCH1-Fcknob_PGLALA-DP47 VH | see Table 3 |

TABLE C-continued (Sequences):

| SEQ ID NO: | Name | Sequence |
|---|---|---|
| 92 | CD40 VHCH1-CD40 VHCH1-Fchole_PGLALA-DP47 VL | see Table 3 |
| 93 | CD40 VHCH1-CD40 VHCH1-Fc_PGLALA-DP47 VLCH1 EE | see Table 3 |
| 94 | DP47VHCL | see Table 3 |
| 95 | muCD40 VHCH1-muCD40 VHCH1-FcKK_DAPG-28H1 VH | see Table 3 |
| 96 | muCD40 VHCH1-muCD40 VHCH1-FcDD_DAPG-28H1 VL | see Table 3 |
| 97 | mu CD40 light chain | see Table 3 |
| 98 | muCD40 VHCH1-muCD40 VHCH1-Fc_DAPG-28H1 VLCH1 | see Table 3 |
| 99 | 28H1 VHCL (mu) | see Table 3 |
| 100 | mu CD40 light chain; 'RK' | see Table 3 |
| 101 | muCD40 VHCH1-muCD40 VHCH1-FcKK_DAPG-DP47 VH | see Table 3 |
| 102 | muCD40 VHCH1-muCD40 VHCH1-FcDD_DAPG-DP47 VL | see Table 3 |
| 103 | muCD40 VHCH1-muCD40 VHCH1-Fc_DAPG-28H1 VLCH1 | see Table 3 |
| 104 | DP47 VHCL (mu) | see Table 3 |
| 105 | CD40 IgG heavy chain (nucleotide sequence) | see Table 4 |
| 106 | CD40 light chain (nucleotide sequence) | see Table 4 |
| 107 | CD40 VHCH1-CD40 VHCH1-Fcknob_PGLALA-28H1 VH | see Table 4 |
| 108 | CD40 VHCH1-CD40 VHCH1-Fchole_PGLALA-28H1 VL | see Table 4 |
| 109 | CD40 VHCH1-CD40 VHCH1-Fc_PGLALA-28H1 VLCH1 EE | see Table 4 |
| 110 | CD40 light chain RK | see Table 4 |
| 111 | 28H1 VHCL | see Table 4 |
| 112 | huCD40_Fchole_PGLALA_28H1 VL | see Table 4 |
| 113 | huCD40_Fc knob_PGLALA_28H1 VH | see Table 4 |
| 114 | huCD40-Fc_PGLALA_28H1_VLCH1 EE | see Table 4 |

TABLE C-continued (Sequences):

| SEQ ID NO: | Name | Sequence |
|---|---|---|
| 115 | CD40 VHCH1-CD40 VHCH1-Fc knob_PGLALA-DP47 VH | see Table 4 |
| 116 | CD40 VHCH1-CD40 VHCH1-Fc hole_PGLALA-DP47 VL | see Table 4 |
| 117 | CD40 VHCH1-CD40 VHCH1-Fc_PGLALA-DP47 VLCH1 EE | see Table 4 |
| 118 | DP47 VHCL | see Table 4 |
| 119 | muCD40 VHCH1-muCD40 VHCH1-FcKK_DAPG-28H1 VH | see Table 4 |
| 120 | muCD40 VHCH1-muC4D40 VHCH1-FcDD_DAPG-28H1 VL | see Table 4 |
| 121 | muCD40 light chain | see Table 4 |
| 122 | muCD40 VHCH1-muCD40 VHCH1-Fc_DAPG-28H1 VLCH1 | see Table 4 |
| 123 | 28H1 VHCL (mu) | see Table 4 |
| 124 | mu CD40 light chain; 'RK' | see Table 4 |
| 125 | muCD40 VHCH1-muCD40 VHCH1-FcKK_DAPG-DP47 VH | see Table 4 |
| 126 | muCD40 VHCH1-mu CD40 VHCH1-FcDD_DAPG-DP47 VL | see Table 4 |
| 127 | muCD40 VHCH1-muCD40 VHCH1-Fc_DAPG-28H1 VLCH1 | see Table 4 |
| 128 | DP47 VHCL (mu) | see Table 4 |
| 129 | CD40 (S2C6) VH | EVQLQQSGPD LVKPGASVKI SCKASGYSFT GYYIHWVKQS HGKSLEWIGR VIPNNGGTSY NQKFKGKAIL TVDKSSSTAY MELRSLTSED SAVYYCAREG IYWWGHGTTL TVSS |
| 130 | CD40 (S2C6) VL | DVVVTQTPLS LPVSLGAQAS ISCRSSQSLV HSNGNTFLHW YLQKPGQSPK LLIYTVSNRF SGVPDRFSGS GSGTDFTLKI SRVEAEDLGV YFCSQTTHVP WTFGGGTKLE IQ |
| 131 | hVH3_CD40 VHCH1-VHCH1-Fc knob_PGLALA-4B9 VH | see Table 27 |
| 132 | hVH3_CD40 VHCH1-VHCH1-Fc hole_PGLALA-4B9 VL | see Table 27 |
| 133 | hVK2_CD40 light chain | see Table 27 |
| 134 | hVH3_CD40 VHCH1-Fc knob_PGLALA-4B9 VH | see Table 27 |
| 135 | hVH3_CD40 VHCH1-Fc hole_PGLALA-4B9 VL | see Table 27 |

TABLE C-continued (Sequences):

| SEQ ID NO: | Name | Sequence |
|---|---|---|
| 136 | hVH3 CD40-Fc knob_PGLALA_4B9_VLCH1 'EE' | see Table 27 |
| 137 | hVK2_CD40 LC ,RK' | see Table 27 |
| 138 | 4B9 VHCL | see Table 27 |
| 139 | hVH3 CD40-Fc hole_PGLALA 'EE' | see Table 27 |
| 140 | hVH3 CD40-Fc hole_PGLALA 'EE' | see Table 27 |
| 141 | 4B9-Fc knob_PGLALA | see Table 27 |
| 142 | hu FAP ectodomain + poly-lys-tag + his$_6$-tag | RPSRVHNSEENTMRALTLKDILNGTFSYKTFFPNW ISGQEYLHQSADNNIVLYNIETGQSYTILSNRTMK SVNASNYGLSPDRQFVYLESDYSKLWRYSYTATYY IYDLSNGEFVRGNELPRPIQYLCWSPVGSKLAYVY QNNIYLKQRPGDPPFQITFNGRENKIFNGIPDWVY EEEMLATKYALWWSPNGKFLAYAEFNDTDIPVIAY SYYGDEQYPRTINIPYPKAGAKNPVVRIFIIDTTY PAYVGPQEVPVPAMIASSDYYFSWLTWVTDERVCL QWLKRVQNVSVLSICDFREDWQTWDCPKTQEHIEE SRTGWAGGFFVSTPVFSYDAISYYKIFSDKDGYKH IHYIKDTVENAIQITSGKWEAINIFRVTQDSLFYS SNEFEEYPGRRNIYRISIGSYPPSKKCVTCHLRKE RCQYYTASFSDYAKYYALVCYGPGIPISTLHDGRT DQEIKILEENKELENALKNIQLPKEEIKKLEVDEI TLWYKMILPPQFDRSKKYPLLIQVYGGPCSQSVRS VFAVNWISYLASKEGMVIALVDGRGTAFQGDKLLY AVYRKLGVYEVEDQITAVRKFIEMGFIDEKRIAIW GWSYGGYVSSLALASGTGLFKCGIAVAPVSSWEYY ASVYTERFMGLPTKDDNLEHYKNSTVMARAEYFRN VDYLLIHGTADDNVHFQNSAQIAKALVNAQVDFQA MWYSDQNHGLSGLSTNHLYTHMTHFLKQCFSLSDG KKKKKKGHHHHHH |
| 143 | mouse FAP | UniProt no. P97321 |
| 144 | Murine FAP ectodomain + poly-lys-tag + his$_6$-tag | RPSRVYKPEGNTKRALTLKDILNGTFSYKTYFPNW ISEQEYLHQSEDDNIVFYNIETRESYIILSNSTMK SVNATDYGLSPDRQFVYLESDYSKLWRYSYTATYY IYDLQNGEFVRGYELPRPIQYLCWSPVGSKLAYVY QNNIYLKQRPGDPPFQITYTGRENRIFNGIPDWVY EEEMLATKYALWWSPDGKFLAYVEFNDSDIPIIAY SYYGDGQYPRTINIPYPKAGAKNPVVRVFIVDTTY PHHVGPMEVPVPEMIASSDYYFSWLTWVSSERVCL QWLKRVQNVSVLSICDFREDWHAWECPKNQEHVEE SRTGWAGGFFVSTPAFSQDATSYYKIFSDKDGYKH IHYIKDTVENAIQITSGKWEAIYIFRVTQDSLFYS SNEFEGYPGRRNIYRISIGNSPPSKKCVTCHLRKE RCQYYTASFSYKAKYYALVCYGPGLPISTLHDGRT DQEIQVLEENKELENSLRNIQLPKVEIKKLKDGGL TFWYKMILPPQFDRSKKYPLLIQVYGGPCSQSVKS VFAVNWITYLASKEGIVIALVDGRGTAFQGDKFLH AVYRKLGVYEVEDQLTAVRKFIEMGFIDEERIAIW GWSYGGYVSSLALASGTGLFKCGIAVAPVSSWEYY ASIYSERFMGLPTKDDNLEHYKNSTVMARAEYFRN VDYLLIHGTADDNVHFQNSAQIAKALVNAQVDFQA MWYSDQNHGILSGRSQNHLYTHMTHFLKQCFSLSD GKKKKKKGHHHHHH |
| 145 | Cynomolgus FAP ectodomain + poly-lys-tag + his$_6$-tag | RPPRVHNSEENTMRALTLKDILNGTFSYKTFFPNW ISGQEYLHQSADNNIVLYNIETGQSYTILSNRTMK SVNASNYGLSPDRQFVYLESDYSKLWRYSYTATYY IYDLSNGEFVRGNELPRPIQYLCWSPVGSKLAYVY QNNIYLKQRPGDPPFQITFNGRENKIFNGIPDWVY EEEMLATKYALWWSPNGKFLAYAEFNDTDIPVIAY SYYGDEQYPRTINIPYPKAGAKNPFVRIFIIDTTY PAYVGPQEVPVPAMIASSDYYFSWLTWVTDERVCL QWLKRVQNVSVLSICDFREDWQTWDCPKTQEHIEE SRTGWAGGFFVSTPVFSYDAISYYKIFSDKDGYKH |

TABLE C-continued (Sequences):

| SEQ ID NO: | Name | Sequence |
|---|---|---|
| | | IHYIKDTVENAIQITSGKWEAINIFRVTQDSLFYS SNEFEDYPGRRNIYRISIGSYPPSKKCVTCHLRKE RCQYYTASFSDYAKYYALVCYGPGIPISTLHDGRT DQEIKILEENKELENALKNIQLPKEEIKKLEVDEI TLWYKMILPPQFDRSKKYPLLIQVYGGPCSQSVRS VFAVNWISYLASKEGMVIALVDGRGTAFQGDKLLY AVYRKLGVYEVEDQITAVRKFIEMGFIDEKRIAIW GWSYGGYVSSLALASGTGLFKCGIAVAPVSSWEYY ASVYTERFMGLPTKDDNLEHYKNSTVMARAEYFRN VDYLLIHGTADDNVHFQNSAQIAKALVNAQVDFQA MWYSDQNHGLSGLSTNHLYTHMTHFLKQCFSLSDG KKKKKKGHHHHHH |
| 146 | murine CD40 | UniProt P27512, version 160 MVSLPRLCAL WGCLLTAVHL GQCVTCSDKQ YLHDGQCCDL CQPGSRLTSH CTALEKTQCH PCDSGEFSAQ WNREIRCHQH RHCEPNQGLR VKKEGTAESD TVCTCKEGQH CTSKDCEACA QHTPCIPGFG VMEMATETTD TVCHPCPVGF FSNQSSLFEK CYPWTSCEDK NLEVLQKGTS QTNVICGLKS RMRALLVIPV VMGILITIFG VFLYIKKVVK KPKDNEILPP AARRQDPQEM EDYPGHNTAA PVQETLHGCQ PVTQEDGKES RISVQERQVT DSIALRPLV |
| 147 | Peptide linker (G45) | GGGGS |
| 148 | Peptide linker (G45)₂ | GGGGSGGGGS |
| 149 | Peptide linker (SG4)₂ | SGGGGSGGGG |
| 150 | Peptide linker G4(SG4)₂ | GGGGSGGGGSGGGG |
| 151 | peptide linker | GSPGSSSSGS |
| 152 | (G4S)₃ peptide linker | GGGGSGGGGSGGGGS₃ |
| 153 | (G4S)₄ peptide linker | GGGGSGGGGSGGGGSGGGGS |
| 154 | peptide linker | GSGSGSGS |
| 155 | peptide linker | GSGSGNGS |
| 156 | peptide linker | GGSGSGSG |
| 157 | peptide linker | GGSGSG |
| 158 | peptide linker | GGSG |
| 159 | peptide linker | GGSGNGSG |
| 160 | peptide linker | GGNGSGSG |
| 161 | peptide linker | GGNGSG |
| 162 | 28H1 light chain cross VHCL | see Table 6 |
| 163 | 28H1 (VLCH1)_Fc knob_ PGLALA | see Table 6 |
| 164 | CD40 (VHCH1 charged)_Fc hole PGLALA | see Table 6 |
| 165 | CD40 light chain (charged) | see Table 6 |
| 166 | CD40 (VHCH1 charged)_28H1 (VLCH1)_FC knob_ PGLALA | see Table 6 |
| 167 | CD40 (VHCH1 charged)_Fc knob_PGLALA_28H1 (VLCH1) | see Table 6 |

TABLE C-continued (Sequences):

| SEQ ID NO: | Name | Sequence |
|---|---|---|
| 168 | CD40 (VHCH1 charged)_Fc hole PGLALA | see Table 6 |
| 169 | CD40 (VHCH1 charged_CD40 (VHCH1 charged)-Fc knob_PGLALA_28H1 (VLCH1) | see Table 6 |
| 170 | CD40 (VHCH1 charged_CD40 (VHCH1 charged)-Fc hole_PGLALA | see Table 6 |
| 171 | VH1a (CD40) | see Table 20 |
| 172 | VH1b (CD40) | see Table 20 |
| 173 | VH1c (CD40) | see Table 20 |
| 174 | VH1d (CD40) | see Table 20 |
| 175 | VL1a (CD40) | see Table 20 |
| 176 | VL1b (CD40) | see Table 20 |
| 177 | VL1c (CD40) | see Table 20 |
| 178 | VL1d (CD40) | see Table 20 |
| 179 | VH2a (CD40) | see Table 21 |
| 180 | VH2b (CD40) | see Table 21 |
| 181 | VH2c (CD40) | see Table 21 |
| 182 | VH2d (CD40) | see Table 21 |
| 183 | VH2ab (CD40) | see Table 21 |
| 184 | VH2ac (CD40) | see Table 21 |
| 185 | VL2a (CD40) | see Table 21 |
| 186 | VL2b (CD40) | see Table 21 |
| 187 | VL2ab (CD40) | see Table 21 |
| 188 | VL2ac (CD40) | see Table 21 |
| 189 | P1AE0400 Heavy chain | see Table 23 |
| 190 | P1AE0400 light chain | see Table 23 |
| 191 | P1AE0401 heavy chain | see Table 23 |
| 192 | P1AE0401 light chain | see Table 23 |
| 193 | P1AE0402 heavy chain | see Table 23 |
| 194 | P1AE0402 light chain | see Table 23 |
| 195 | P1AE0403 heavy chain | see Table 23 |
| 196 | P1AE0403 light chain | see Table 23 |
| 197 | P1AE0404 heavy chain | see Table 23 |
| 198 | P1AE0404 light chain | see Table 23 |
| 199 | P1AE0405 heavy chain | see Table 23 |
| 200 | P1AE0405 light chain | see Table 23 |
| 201 | P1AE0406 heavy chain | see Table 23 |

TABLE C-continued (Sequences):

| SEQ ID NO: | Name | Sequence |
|---|---|---|
| 202 | P1AE0406 light chain | see Table 23 |
| 203 | P1AE0407 heavy chain | see Table 23 |
| 204 | P1AE0407 light chain | see Table 23 |
| 205 | P1AE0817 heavy chain | see Table 23 |
| 206 | P1AE0817 light chain | see Table 23 |
| 207 | P1AE0818 heavy chain | see Table 23 |
| 208 | P1AE0818 light chain | see Table 23 |
| 209 | P1AE0819 heavy chain | see Table 23 |
| 210 | P1AE0819 light chain | see Table 23 |
| 211 | P1AE0993 heavy chain | see Table 23 |
| 212 | P1AE0993 light chain | see Table 23 |
| 213 | P1AE0996 heavy chain | see Table 23 |
| 214 | P1AE0996 light chain | see Table 23 |
| 215 | P1AE0997 heavy chain | see Table 23 |
| 216 | P1AE0997 light chain | see Table 23 |
| 217 | P1AE0998 heavy chain | see Table 23 |
| 218 | P1AE0998 light chain | see Table 23 |
| 219 | P1AE0999 heavy chain | see Table 23 |
| 220 | P1AE0999 light chain | see Table 23 |
| 221 | P1AE1000 heavy chain | see Table 23 |
| 222 | P1AE1000 light chain | see Table 23 |
| 223 | P1AE1001 heavy chain | see Table 23 |
| 224 | P1AE1001 light chain | see Table 23 |
| 225 | P1AE1002 heavy chain | see Table 23 |
| 226 | P1AE1002 light chain | see Table 23 |
| 227 | P1AE1003 heavy chain | see Table 23 |
| 228 | P1AE1003 light chain | see Table 23 |
| 229 | P1AE1004 heavy chain | see Table 23 |
| 230 | P1AE1004 light chain | see Table 23 |
| 231 | P1AE1005 heavy chain | see Table 23 |
| 232 | P1AE1005 light chain | see Table 23 |
| 233 | P1AE1006 heavy chain | see Table 23 |
| 234 | P1AE1006 light chain | see Table 23 |
| 235 | P1AE1007 heavy chain | see Table 23 |
| 236 | P1AE1007 light chain | see Table 23 |
| 237 | P1AE1125 heavy chain | see Table 23 |
| 238 | P1AE1125 light chain | see Table 23 |
| 239 | P1AE1126 heavy chain | see Table 23 |

TABLE C-continued (Sequences):

| SEQ ID NO: | Name | Sequence |
|---|---|---|
| 240 | P1AE1126 light chain | see Table 23 |
| 241 | P1AE1135 heavy chain | see Table 23 |
| 242 | P1AE1135 light chain | see Table 23 |
| 243 | VL2a (CD40) light chain (charged) | see Table 28 |
| 244 | VH2a (CD40) (VHCH1 charged_VH2a (CD40) (VHCH1 charged)-Fc knob_PGLALA_28H1 (VLCH1) | see Table 28 |
| 245 | VH2a (CD40) (VHCH1 charged_VH2a (CD40) (VHCH1 charged)-Fc hole_PGLALA | see Table 28 |
| 246 | VH2d (CD40) (VHCH1 charged_VH2d (CD40) (VHCH1 charged)-Fc knob_PGLALA_28H1 (VLCH1) | see Table 28 |
| 247 | VH2d (CD40) (VHCH1 charged_VH2d (CD40) (VHCH1 charged)-Fc hole_PGLALA | see Table 28 |
| 248 | VL1a (CD40) light chain (charged) | see Table 28 |
| 249 | VH1a (CD40) (VHCH1)_VH1a (CD40) (VHCH1)-Fc knob_PGLALA_28H1 (VLCH1) (charged) | see Table 28 |
| 250 | VH1a (CD40) (VHCH1)_VH1a (CD40) (VHCH1)-Fc hole_PGLALA (charged) | see Table 28 |
| 251 | VH1a (CD40) (VHCH1) Fc knob_PGLALA_28H1 (VLCH1) (charged) | see Table 28 |
| 252 | VH1a (CD40) (VHCH1) Fc hole_PGLALA (charged) | see Table 28 |
| 253 | VH1a (CD40) (VHCH1) Fc knob_PGLALA_4B9 (VLCH1) (charged) | see Table 28 |
| 254 | 4B9 light chain cross VLCH | see Table 28 |
| 255 | VH1a (CD40) (VHCH1) Fc knob_PGLALA_4B9 (VHCL) (charged) | see Table 28 |
| 256 | VL1a (CD40) light chain | see Table 28 |
| 257 | VH1a (CD40) (VHCH1) Fc knob_PGLALA_4B9 (VHCL) | see Table 28 |
| 258 | VH1a (CD40) (VHCH1) Fc hole_PGLALA | see Table 28 |
| 259 | P1AE0816 heavy chain (control) | see Table 23 |
| 260 | P1AE0816 light chain (control) | see Table 23 |

TABLE C-continued (Sequences):

| SEQ ID NO: | Name | Sequence |
|---|---|---|
| 261 | hu CD40 CDR-H1 (VH2ab) | GYYMH |
| 262 | hu CD40 CDR-H2 (VH2ab) | RVIPNAGGTSYNQKFKG |
| 263 | hu CD40 CDR-H2 (VH2ac) | RVIPNAGGTSYNQKVKG |
| 264 | hu CD40 CDR-L1 (VL2ab) | RASQSLVHSNGNTFLH |
| 265 | hu CD40 CDR-L1 (VL2ac) | RSSQSIVHSNGNTFLH |
| 266 | Hu_CD40_ECD_His_Avi | EPPTACREKQYLINSQCCSLCQPGQKLVSDCTEFT ETECLPCGESEFLDTWNRETHCHQHKYCDPNLGLR VQQKGTSETDTICTCEEGWHCTSEACESCVLHRSC SPGFGVKQIATGVSDTICEPCPVGFFSNVSSAFEK CHPWTSCETKDLVVQQAGTNKTDVVCGPQDRLRGG GGSHHHHHHGSGLNDIFEAQKIEWHE |
| 267 | cyno_CD40_ECD_His_Avi | EPPTACREKQYLINSQCCSLCQPGQKLVSDCTEFT ETECLPCSESEFLDTWNRETRCHQHKYCDPNLGLR VQQKGTSETDTICTCEEGLHCTSESCESCVPHRSC LPGFGVKQIATGVSDTICEPCPVGFFSNVSSAFEK CRPWTSCETKDLVVQQAGTNKTDVVCGPQDRQRGG GGSHHHHHHGSGLNDIFEAQKIEWHE |
| 268 | Selicrelumab IgG2 heavy chain (control) | QVQLVQSGAEVKKPGASVKVSCKASGYTFTGYYMH WVRQAPGQGLEWMGWINPDSGGTNYAQKFQGRVTM TRDTSISTAYMELNRLRSDDTAVYYCARDQPLGYC TNGVCSYFDYWGQGTLVTVSSASTKGPSVFPLAPC SRSTSESTAALGCLVKDYFPEPVTVSWNSGALTSG VHTFPAVLQSSGLYSLSSVVTVPSSNFGTQTYTCN VDHKPSNTKVDKTVERKCCVECPPCPAPPVAGPSV FLFPPKPKDTLMISRTPEVTCVVVDVSHEDPEVQF NWYVDGVEVHNAKTKPREEQFNSTRFVVSVLTVVH QDWLNGKEYKCKVSNKGLPAPIEKTISKTKGQPRE PQVYTLPPSREEMTKNQVSLTCLVKGFYPSDIAVE WESNGQPENNYKTTPPMLDSDGSFFLYSKLTVDKS RWQQGNVFSCSVMHEALHNHYTQKSLSLSPG |
| 269 | Selicrelumab IgG2 light chain (control) | DIQMTQSPSSVSASVGDRVTITCRASQGIYSWLAW YQQKPGKAPNLLIYTASTLQSGVPSRFSGSGSGTD FTLTISSLQPEDFATYYCQQANIFPLTFGGGTKVE IKRTVAAPSVFIFPPSDEQLKSGTASVVCLLNNFY PREAKVQWKVDNALQSGNSQESVTEQDSKDSTYSL SSTLTLSKADYEKHKVYACEVTHQGLSSPVTKSFN RGEC |

The following numbered paragraphs (paras) describe aspects of the present invention according to the first priority application:

1. A bispecific antigen binding molecule, comprising
   (a) at least one antigen binding domain capable of specific binding to CD40, and
   (b) at least one antigen binding domain capable of specific binding to a target cell antigen.

2. The bispecific antigen binding molecule of para 1, additionally comprising
   (c) a Fc region composed of a first and a second subunit capable of stable association.

3. The bispecific antigen binding molecule of para 1 or para 2, wherein the antigen binding domain capable of specific binding to CD40 binds to a polypeptide comprising, or consisting of, the amino acid sequence of SEQ ID NO: 1.

4. The bispecific antigen binding molecule of any one of paras 1 to 3, wherein the antigen binding domain capable of specific binding to a target cell antigen is an antigen binding domain capable of specific binding to Fibroblast Activation Protein (FAP).

5. The bispecific antigen binding molecule of para 1 or para 2, wherein the antigen binding domain capable of specific binding to FAP binds to a polypeptide comprising, or consisting of, the amino acid sequence of SEQ ID NO:2.

6. The bispecific antigen binding molecule of any one of paras 1 to 5, wherein the antigen binding domain capable of specific binding to FAP comprises
   (a) a heavy chain variable region ($V_H$FAP) comprising (i) CDR-H1 comprising the amino acid sequence of SEQ ID NO:3, (ii) CDR-H2 comprising the amino acid sequence of SEQ ID NO: 4, and (iii) CDR-H3 comprising the amino acid sequence of SEQ ID NO:5, and a light chain variable region ($V_L$FAP) comprising (iv) CDR-L1 comprising the amino acid sequence of SEQ ID NO: 6, (v) CDR-L2 comprising the amino acid sequence of SEQ ID NO:7, and (vi) CDR-L3 comprising the amino acid sequence of SEQ ID NO:8, or
   (b) a heavy chain variable region ($V_H$FAP) comprising (i) CDR-H1 comprising the amino acid sequence of SEQ ID NO: 11, (ii) CDR-H2 comprising the amino acid sequence of SEQ ID NO: 12, and (iii) CDR-H3 comprising the amino acid sequence of SEQ ID NO:13, and a light chain variable region (V$_L$FAP) comprising (iv) CDR-L1 comprising the amino acid sequence of SEQ ID NO:14, (v) CDR-L2 comprising the amino acid sequence of SEQ ID NO: 15, and (vi) CDR-L3 comprising the amino acid sequence of SEQ ID NO: 16.

7. The bispecific antigen binding molecule of any one of paras 1 to 6, wherein the antigen binding domain capable of specific binding to FAP comprises
   (a) a heavy chain variable region (V$_H$FAP) comprising an amino acid sequence that is at least about 95%, 96%, 97%, 98%, 99% or 100% identical to the amino acid sequence of SEQ ID NO: 9, and a light chain variable region (V$_L$FAP) comprising an amino acid sequence that is at least about 95%, 96%, 97%, 98%, 99% or 100% identical to the amino acid sequence of SEQ ID NO: 10, or
   (b) a heavy chain variable region (V$_H$FAP) comprising an amino acid sequence that is at least about 95%, 96%, 97%, 98%, 99% or 100% identical to the amino acid sequence of SEQ ID NO: 17, and a light chain variable region (V$_L$FAP) comprising an amino acid sequence that is at least about 95%, 96%, 97%, 98%, 99% or 100% identical to the amino acid sequence of SEQ ID NO: 18.

8. The bispecific antigen binding molecule of any one of paras 1 to 7, wherein the antigen binding domain capable of specific binding to CD40 comprises a heavy chain variable region (V$_H$CD40) comprising (i) CDR-H1 comprising the amino acid sequence of SEQ ID NO: 19, (ii) CDR-H2 comprising the amino acid sequence of SEQ ID NO:20, and (iii) CDR-H3 comprising the amino acid sequence of SEQ ID NO:21, and a light chain variable region (V$_L$CD40) comprising (iv) CDR-L1 comprising the amino acid sequence of SEQ ID NO:22, (v) CDR-L2 comprising the amino acid sequence of SEQ ID NO:23, and (vi) CDR-L3 comprising the amino acid sequence of SEQ ID NO:24.

9. The bispecific antigen binding molecule of any one of paras 1 to 7, wherein the antigen binding domain capable of specific binding to CD40 comprises a heavy chain variable region (V$_H$CD40) comprising (i) CDR-H1 comprising the amino acid sequence of SEQ ID NO:27, (ii) CDR-H2 comprising the amino acid sequence of SEQ ID NO:28, and (iii) CDR-H3 comprising the amino acid sequence of SEQ ID NO:29, and a light chain variable region (V$_L$CD40) comprising (iv) CDR-L1 comprising the amino acid sequence of SEQ ID NO:30, (v) CDR-L2 comprising the amino acid sequence of SEQ ID NO:31, and (vi) CDR-L3 comprising the amino acid sequence of SEQ ID NO:32.

10. The bispecific antigen binding molecule of any one of paras 1 to 9, wherein the antigen binding domain capable of specific binding to CD40 comprises
    (a) a VH comprising the amino acid sequence of SEQ ID NO:25 and a VL comprising the amino acid sequence of SEQ ID NO:26, or
    (b) a VH comprising the amino acid sequence of SEQ ID NO:33 and a VL comprising the amino acid sequence of SEQ ID NO:34.

11. The bispecific antigen binding molecule of any one of paras 1 to 8, wherein the antigen binding domain capable of specific binding to CD40 comprises
    (i) a heavy chain variable region (V$_H$CD40) comprising an amino acid sequence selected from the group consisting of SEQ ID NO:45, SEQ ID NO:46, SEQ ID NO:47, SEQ ID NO:48, SEQ ID NO:49, SEQ ID NO:50, SEQ ID NO:51, SEQ ID NO:52, SEQ ID NO:53, SEQ ID NO: 54 and SEQ ID NO:55, and
    (ii) a light chain variable region (V$_L$CD40) comprising the amino acid sequence selected from the group consisting of SEQ ID NO:56, SEQ ID NO:57, SEQ ID NO:58, SEQ ID NO:59, SEQ ID NO:60, SEQ ID NO:61, SEQ ID NO:62, SEQ ID NO:63 and SEQ ID NO:64.

12. The bispecific antigen binding molecule of any one of paras 1 to 8 or 11, wherein the antigen binding domain capable of specific binding to CD40 comprises a VH comprising the amino acid sequence of SEQ ID NO:47 and a VL comprising the amino acid sequence of SEQ ID NO: 57.

13. The bispecific antigen binding molecule of any one of paras 1 to 8, comprising
    (i) at least one antigen binding domain capable of specific binding to CD40, comprising a heavy chain variable region (V$_H$CD40) comprising an amino acid sequence selected from the group consisting of SEQ ID NO:25, SEQ ID NO:45, SEQ ID NO:46, SEQ ID NO:47, SEQ ID NO: 48, SEQ ID NO:49, SEQ ID NO:50, SEQ ID NO:51, SEQ ID NO:52, SEQ ID NO:53, SEQ ID NO: 54 and SEQ ID NO:55, and a light chain variable region (V$_L$CD40) comprising an amino acid sequence selected from the group consisting of SEQ ID NO:26, SEQ ID NO:56, SEQ ID NO: 57, SEQ ID NO:58, SEQ ID NO:59, SEQ ID NO:60, SEQ ID NO:61, SEQ ID NO:62, SEQ ID NO: 63 and SEQ ID NO:64, and
    (ii) at least one antigen binding domain capable of specific binding to FAP, comprising a heavy chain variable region (V$_H$FAP) comprising an amino acid sequence of SEQ ID NO:9 and a light chain variable region (V$_L$FAP) comprising an amino acid sequence of SEQ ID NO: 10, or a heavy chain variable region (V$_H$FAP) comprising an amino acid sequence of SEQ ID NO:17 and a light chain variable region (V$_L$FAP) comprising an amino acid sequence of SEQ ID NO:18.

14. The bispecific antigen binding molecule of any one of paras 2 to 13, wherein the Fc region is an IgG, particularly an IgG1 Fc region or an IgG4 Fc region.

15. The bispecific antigen binding molecule of any one of paras 2 to 14, wherein the Fc region comprises one or more amino acid substitution that reduces the binding affinity of the antibody to an Fc receptor and/or effector function.

16. The bispecific antigen binding molecule of any one of paras 2 to 15, wherein the Fc region is (i) of human IgG1 subclass with the amino acid mutations L234A, L235A and P329G (numbering according to Kabat EU index), or (ii) of mouse IgG1 subclass with the amino acid mutations D265A and P329G (numbering according to Kabat EU index).

17. The bispecific antigen binding molecule of any one of paras 2 to 16, wherein the Fc region comprises a modification promoting the association of the first and second subunit of the Fc region.

18. The bispecific antigen binding molecule of any one of paras 2 to 17, wherein the first subunit of the Fc region comprises knobs and the second subunit of the Fc region comprises holes according to the knobs into holes method.

19. The bispecific antibody of any one of paras 2 to 18, wherein
    (i) the first subunit of the Fc region comprises the amino acid substitutions S354C and T366W (numbering according to Kabat EU index) and the second subunit of the Fc region comprises the amino acid substitutions γ349C, T366S and γ407V (numbering according to Kabat EU index), or
    (ii) the first subunit of the Fc region comprises the amino acid substitutions K392D and K409D (numbering according to Kabat EU index) and the second subunit of the Fc region comprises the amino acid substitutions E356K and D399K (numbering according to Kabat EU index).

20. The bispecific antigen binding molecule of any one of paras 1 to 19, wherein the bispecific antigen binding molecule comprises
    (a) at least two Fab fragments capable of specific binding to CD40 connected to a Fc region, and
    (b) at least one antigen binding domain capable of specific binding to FAP connected to the C-terminus of the Fc region.

21. The bispecific antigen binding molecule of any one of paras 1 to 19, wherein the bispecific antigen binding molecule comprises
    (a) two light chains and two heavy chains of an antibody comprising two Fab fragments capable of specific binding to CD40, and a Fc region, and
    (b) a VH and a VL of an antigen binding domain capable specific binding to FAP, wherein the VH is connected to the C-terminus of one of the two heavy chains of (a), and wherein the VL is connected to the C-terminus of the other of the two heavy chains of (a).

22. The bispecific antigen binding molecule of any one of paras 1 to 19, wherein the bispecific antigen binding molecule comprises
    (a) two light chains and two heavy chains of an antibody comprising two Fab fragments capable of specific binding to CD40, and a Fc region, and
    (b) two Fab fragments capable of specific binding to FAP, wherein one of the Fab fragments is connected to the C-terminus of one of the two heavy chains of (a), and the other of the Fab fragments is connected to the C-terminus of the other of the two heavy chains of (a).

23. The bispecific antigen binding molecule of any one of paras 1 to 19, wherein the bispecific antigen binding molecule comprises
    (a) two heavy chains, each heavy chain comprising a VH and CH1 domain of a Fab fragment capable of specific binding to CD40 and a Fc region subunit,
    (b) two light chains, each light chain comprising a VL and CL domain of a Fab fragment capable of specific binding to CD40, and
    (c) a VH and a VL of an antigen binding domain capable of specific binding to FAP, wherein the VH is connected to the C-terminus of one of the two heavy chains of (a), and wherein the VL is connected to the C-terminus of the other of the two heavy chains of (a).

24. The bispecific antigen binding molecule of any one of paras 1 to 19, wherein the bispecific antigen binding molecule comprises
    (a) two heavy chains, each heavy chain comprising a VH and CH1 domain of a Fab fragment capable of specific binding to CD40, and a Fc region subunit,
    (b) two light chains, each light chain comprising a VL and CL domain of a Fab fragment capable of specific binding to CD40, and
    (c) two Fab fragments capable of specific binding to FAP, wherein one of the Fab fragments is connected to the C-terminus of one of the two heavy chains of (a), and the other of the Fab fragments is connected to the C-terminus of the other of the two heavy chains of (a).

25. The bispecific antigen binding molecule of any one of paras 1 to 19, wherein the bispecific antigen binding molecule comprises
    (a) two heavy chains, each heavy chain comprising a VH and CH1 domain of a Fab fragment capable of specific binding to CD40, and a Fc region subunit,
    (b) two light chains, each light chain comprising a VL and CL domain of a Fab fragment capable of specific binding to CD40, and
    (c) one Fab fragment capable of specific binding to FAP, wherein the Fab fragments is connected to the C-terminus of one of the two heavy chains of (a).

26. The bispecific antigen binding molecule of any one of paras 22 to 25, wherein the Fab fragment or the two Fab fragments capable of specific binding to FAP are crossover Fab fragments each comprising a VL-CH1 chain and a VH-CL chain, and wherein the VL-CH1 chain is connected to the C-terminus of one of the two heavy chains of (a).

27. The bispecific antigen binding molecule of any one of paras 1 to 26, wherein the bispecific antigen binding molecule comprises four Fab fragments capable of specific binding to CD40.

28. The bispecific antigen binding molecule of any one of paras 23 to 27, wherein each of the two heavy chains of (a) comprises two VHs and two CH1 domains of a Fab fragment capable of specific binding to CD40.

29. The bispecific antigen binding molecule of any one of paras 23 to 28, wherein one or more of the Fab fragments capable of specific binding to CD40 comprises
    a CL domain comprising an arginine (R) at amino acid at position 123 (numbering according to Kabat EU index) and a lysine (K) at amino acid at position 124 (numbering according to Kabat EU index), and
    a CH1 domain comprising a glutamic acid (E) at amino acid at position 147 (numbering according to Kabat EU index) and a glutamic acid (E) at amino acid at position 213 (numbering according to Kabat EU index).

30. A polynucleotide encoding the bispecific antigen binding molecule of any one of paras 1 to 29.

31. An expression vector comprising the polynucleotide of claim 30.

32. A host cell comprising the polynucleotide of para 30 or the expression vector of para 31.

33. A method of producing a bispecific antigen binding molecule, comprising culturing the host cell of para 32 under conditions suitable for the expression of the bispecific antigen binding molecule, and isolating the bispecific antigen binding molecule.

34. A pharmaceutical composition comprising the bispecific antigen binding molecule of any one of paras 1 to 29 and at least one pharmaceutically acceptable excipient.

35. The bispecific antigen binding molecule of any one of paras 1 to 29, or the pharmaceutical composition of para 34, for use as a medicament.

36. The bispecific antigen binding molecule of any one of paras 1 to 29, or the pharmaceutical composition of para 34, for use
    (i) in inducing immune stimulation by CD40$^+$ antigen-presenting cells (APCs),
    (ii) in stimulating tumor-specific T cell response,
    (iii) in causing apoptosis of tumor cells,
    (iv) in the treatment of cancer,
    (v) in delaying progression of cancer,
    (vi) in prolonging the survival of a patient suffering from cancer,
    (vii) in the treatment of infections.

37. The bispecific antigen binding molecule of any one of paras 1 to 29, or the pharmaceutical composition of para 34, for use in the treatment of cancer.

38. Use of the bispecific antigen binding molecule of any one of paras 1 to 29, or the pharmaceutical composition of para 34, in the manufacture of a medicament for the treatment of cancer.

39. A method of treating an individual having cancer comprising administering to the individual an effective amount of the bispecific antigen binding molecule of any one of paras 1 to 29, or the pharmaceutical composition of para 34.

40. The bispecific antigen binding molecule of any one of paras 1 to 29, or the pharmaceutical composition of para 34, for use in up-regulating or prolonging cytotoxic T cell activity.

41. The bispecific antigen binding molecule according to any one of paras 1 to 29 or the pharmaceutical composition according to para 34 for use in the treatment of cancer, wherein the bispecific antigen binding molecule is administered in combination with a chemotherapeutic agent, radiation and/or other agents for use in cancer immunotherapy.

EXAMPLES

The following are examples of methods and compositions of the invention. It is understood that various other embodiments may be practiced, given the general description provided above.
Recombinant DNA Techniques
Standard methods were used to manipulate DNA as described in Sambrook et al., Molecular cloning: A laboratory manual: Cold Spring Harbor Laboratory Press, Cold Spring Harbor, New York, 1989. The molecular biological reagents were used according to the manufacturer's instructions. General information regarding the nucleotide sequences of human immunoglobulin light and heavy chains is given in: Kabat, E. A. et al., (1991) Sequences of Proteins of Immunological Interest, Fifth Ed., NIH Publication No 91-3242.
DNA Sequencing
DNA sequences were determined by double strand sequencing.
Gene Synthesis
Desired gene segments were either generated by PCR using appropriate templates or were synthesized by Geneart A G (Regensburg, Germany) from synthetic oligonucleotides and PCR products by automated gene synthesis. In cases where no exact gene sequence was available, oligonucleotide primers were designed based on sequences from closest homologues and the genes were isolated by RT-PCR from RNA originating from the appropriate tissue. The gene segments flanked by singular restriction endonuclease cleavage sites were cloned into standard cloning/sequencing vectors. The plasmid DNA was purified from transformed bacteria and concentration determined by UV spectroscopy. The DNA sequence of the subcloned gene fragments was confirmed by DNA sequencing. Gene segments were designed with suitable restriction sites to allow sub-cloning into the respective expression vectors. All constructs were designed with a 5'-end DNA sequence coding for a leader peptide which targets proteins for secretion in eukaryotic cells.
Protein Purification
Proteins were purified from filtered cell culture supernatants referring to standard protocols. In brief, antibodies were applied to a Protein A SEPHAROSE® column (GE healthcare) and washed with PBS. Elution of antibodies was achieved at pH 2.8 followed by immediate neutralization of the sample. Aggregated protein was separated from monomeric antibodies by size exclusion chromatography (SUPERDEX® 200, GE Healthcare) in PBS or in 20 mM Histidine, 150 mM NaCl pH 6.0. Monomeric antibody fractions were pooled, concentrated (if required) using e.g., a MILLIPORE Amicon Ultra (30 MWCO) centrifugal concentrator, frozen and stored at −20° C., or −80° C. Part of the samples were provided for subsequent protein analytics and analytical characterization e.g. by SDS-PAGE, size exclusion chromatography (SEC) or mass spectrometry.
SDS-Page
The NUPAGE® Pre-Cast gel system (Invitrogen) was used according to the manufacturer's instruction. In particular, 10% or 4-12% NUPAGE® NOVEX® Bis-TRIS Pre-Cast gels (pH 6.4) and a NUPAGE® MES (reduced gels, with NUPAGE® Antioxidant running buffer additive) or MOPS (non-reduced gels) running buffer was used.
CE-SDS
Purity, antibody integrity and molecular weight of bispecific and control antibodies were analyzed by CE-SDS using microfluidic LABCHIP® technology (Caliper Life Science, USA). 5 µl of protein solution was prepared for CE-SDS analysis using the HT Protein Express Reagent Kit according manufacturer's instructions and analyzed on a LABCHIP® GXII system using a HT Protein Express Chip. Data were analyzed using LABCHIP® GX Software version 3.0.618.0.
Analytical Size Exclusion Chromatography
Size exclusion chromatography (SEC) for the determination of the aggregation and oligomeric state of antibodies was performed by HPLC chromatography. Briefly, Protein A purified antibodies were applied to a Tosoh TSKGEL® G3000SW column in 300 mM NaCl, 50 mM $KH_2PO_4$/$K_2HPO_4$, pH 7.5 on an Agilent HPLC 1100 system or to a SUPERDEX™ 200 column (GE Healthcare) in 2×PBS on a Dionex HPLC-System. The eluted protein was quantified by UV absorbance and integration of peak areas. BioRad Gel Filtration Standard 151-1901 served as a standard.
Mass Spectrometry
This section describes the characterization of the multispecific antibodies with VH/VL or CH/CL exchange (CrossMAbs) with emphasis on their correct assembly. The expected primary structures were analyzed by electrospray ionization mass spectrometry (ESI-MS) of the deglycosylated intact CrossMAbs and deglycosylated/FabALAC-TICA or alternatively deglycosylated/GINGISKHAN® digested CrossMAbs.
The CrossMAbs were deglycosylated with N-Glycosidase F in a phosphate or Tris buffer at 37° C., for up to 17 h at a protein concentration of 1 mg/ml. The FabALACTICA or GINGISKHAN® (Genovis A B: Sweden) digestions were performed in the buffers supplied by the vendor with 100 µg deglycosylated CrossMAbs. Prior to mass spectrometry the samples were desalted via HPLC on a SEPHADEX R: G25 column (GE Healthcare). The total mass was determined via ESI-MS on a maXis 4G UHR-QTOF MS system (Bruker Daltonik) equipped with a TriVersa NANOMATE® source (Advion).

Example 1

Generation and Production of Bispecific Constructs Targeting CD40 and Fibroblast Activation Protein (FAP)

1.1 Generation of Bispecific Antigen Binding Molecules Targeting CD40 and Fibroblast Activation Protein (FAP)
The cDNAs encoding variable heavy and light chain domains of the anti CD40 binder (SEQ ID NO:10 and SEQ ID NO: 16 of WO 2006/128103) were cloned in frame with the corresponding constant heavy or light chains of human IgG1 in suitable expression plasmids. Expression of heavy and light chain is driven by a chimeric MPSV promoter consisting of the MPSV core promoter and a CMV enhancer element. The expression cassette also contains a synthetic polyA signal at the 3' end of the cDNAs. In addition the plasmid vectors harbor an origin of replication (EBV oriP) for episomal maintenance of the plasmids. Amino acid and nucleotide sequences of the variable domains of the CD40 mAb and the FAP mAb are shown in Table 1 and 2, respectively.

20) Different bispecific CD40-FAP antibodies have been prepared in 4+1 and 4+2 formats consisting of four CD40 binding moieties combined with either one or two FAP binding arms at the C-terminus of an Fc or in 2+1 and 2+2 formats consisting of two CD40 binding moieties combined with either one or two FAP binding arms at the C-terminus of an Fc (FIG. 1A, FIG. 1B, FIG. 1C, and FIG. 1D). The generation and preparation of FAP binder 28H1 is described in WO 2012/020006 A2, which is incorporated herein by reference. To generate the 4+1 and the 2+1 molecules the knob-into-hole technology was used to achieve heterodimerization. The S354C/T366W mutations were introduced in the first heavy chain HC1 (Fc knob heavy chain) and the γ349C/T366S/L368A/γ407V mutations were introduced in the second heavy chain HC2 (Fc hole heavy chain). In the 4+2 and 2+2 molecules the CrossMAbs technology as described in WO 2010/145792 A1 ensured correct light chain pairing. Independent of the bispecific format, in all cases an effector silent Fc (P329G: L234. L235A) was used to abrogate binding to Fcγ receptors according to the method described in WO 2012/130831 A1. Sequences of the bispecific molecules are shown in Table 3 and 4.

Besides molecules targeting the human receptors also surrogate molecules were generated in the same formats that recognize the murine antigens. In these cases the heterodimerization of 4+1 molecules was achieved by DD/KK mutations (introduction of the Lys392Asp and Lys409Asp in the first heavy chain and introduction of the Glu356Lys and Asp399Lys mutation in the second heavy chain) in the Fc according to the method described in by Gunasekaran et al., J. Biol. Chem. 2010, 19637-19646, while binding to Fc receptors was inhibited by D270A/P329G mutations in accordance with the method described in Baudino et al., J. Immunol. (2008), 181, 6664-9, or in WO 2016/030350 A1.

All genes were transiently expressed under control of a chimeric MPSV promoter consisting of the MPSV core promoter combined with the CMV promoter enhancer fragment. The expression vector also contains the oriP region for episomal replication in EBNA (Epstein Barr Virus Nuclear Antigen) containing host cells.

TABLE 1

Amino acid sequences of the variable domains of the CD40 antibodies, the FAP antibody and DP47 antibody

| Description | Sequence | Seq ID No |
|---|---|---|
| hu CD40 VH | EVQLVESGGGLVQPGGSLRLSCAASGYSFTGYYIHWVRQAPGK GLEWVARVIPNAGGTSYNQKFKGRFTLSVDNSKNTAYLQMNSL RAEDTAVYYCAREGIYWWGQGTLVTVSS | 25 |
| hu CD40 VL | DIQMTQSPSSLSASVGDRVTITCRSSQSLVHSNGNTFLHWYQQ KPGKAPKLLIYTVSNRFSGVPSRFSGSGSGTDFTLTISSLQPE DFATYFCSQTTHVPWTFGQGTKVEIK | 26 |
| FAP 28H1 VH | EVQLLESGGGLVQPGGSLRLSCAASGFTFSSHAMSWVRQAPGK GLEWVSAIWASGEQYYADSVKGRFTISRDNSKNTLYLQMNSLR AEDTAVYYCAKGWLGNFDYWGQGTLVTVSS | 9 |
| FAP 28H1 VL | EIVLTQSPGTLSLSPGERATLSCRASQSVSRSYLAWYQQKPGQ APRLLIIGASTRATGIPDRFSGSGSGTDFTLTISRLEPEDFAV YYCQQGQVIPPTFGQGTKVEIK | 10 |
| DP47 VH | EVQLLESGGGLVQPGGSLRLSCAASGFTFSSYAMSWVRQAPGK GLEWVSAISGSGGSTYYADSVKGRFTISRDNSKNTLYLQMNSL RAEDTAVYYCAKGSGFDYWGQGTLVTVSS | 71 |
| DP47 VL | EIVLTQSPGTLSLSPGERATLSCRASQSVSSSYLAWYQQKPGQ APRLLIYGASSRATGIPDRFSGSGSGTDFTLTISRLEPEDFAV YYCQQYGSSPLTFGQGTKVEIK | 72 |
| mu CD40 VH | EVQLVESDGGLVQPGRSLKLPCAASGFTFSDYYMAWVRQAPTK GLEWVASISYDGSSTYYRDSVKGRFTISRDNAKSTLYLQMDSL RSEDTATYYCGRHSSYFDYWGQGVMVTVSS | 33 |
| mu CD40 VL | DTVLTQSPALAVSPGERVTISCRASDSVSTLMHWYQQKPGQQP KLLIYLASHLESGVPARFSGSGSGTDFTLTIDPVEADDTATYY CQQSWNDPWTFGGGTKLELK | 34 |

TABLE 2

Nucleotide sequences of the variable domains of the CD40 antibodies, the FAP antibody and DP47 antibody

| Description | Sequence | Seq ID No |
|---|---|---|
| hu CD40 VH | GAGGTGCAGCTGGTGGAATCTGGCGGCGGACTGGTGCAGCCTG GCGGATCTCTGAGACTGAGCTGTGCCGCCAGCGGCTACAGCTT CACCGGCTACTACATCCACTGGGTGCGCCAGGCCCCTGGCAAG GGACTGGAATGGGTGGCCAGAGTGATCCCCAATGCCGGCGGAA CCAGCTACAACCAGAAGTTCAAGGGCCGGTTCACCCTGAGCGT GGACAACAGCAAGAACACCGCCTACCTGCAGATGAACAGCCTG CGGGCCGAGGACACCGCCGTGTACTATTGTGCCCGCGAGGGCA TCTATTGGTGGGGCCAGGGAACACTCGTGACCGTGTCCAGC | 73 |
| hu CD40 VL | GACATCCAGATGACCCAGAGCCCCAGCAGCCTGTCTGCCAGCG TGGGCGACAGAGTGACCATCACCTGTCGGAGCAGCCAGAGCCT GGTGCACAGCAACGGCAACACCTTCCTGCACTGGTATCAGCAG AAGCCCGGCAAGGCCCCCAAGCTGCTGATCTACACCGTGTCCA ACCGGTTCAGCGGCGTGCCCAGCAGATTTTCTGGCAGCGGCTC CGGCACCGACTTCACCCTGACAATCAGCTCCCTGCAGCCCGAG GACTTCGCCACCTATTTCTGCAGCCAGACCACCCACGTGCCCT GGACATTTGGACAGGGCACCAAGGTGGAAATCAAG | 74 |
| FAP 28H1 VH | GAGGTGCAGCTGCTGGAATCCGGCGGAGGCCTGGTGCAGCCTG GCGGATCTCTGAGACTGTCCTGCGCCGCCTCCGGCTTCACCTT CTCCTCCCACGCCATGTCCTGGGTCCGACAGGCTCCTGGCAAA GGCCTGGAATGGGTGTCCGCCATCTGGGCCTCCGGCGAGCAGT ACTACGCCGACTCTGTGAAGGGCCGGTTCACCATCTCCCGGGA CAACTCCAAGAACACCCTGTACCTGCAGATGAACTCCCTGCGG GCCGAGGACACCGCCGTGTACTACTGTGCCAAGGGCTGGCTGG GCAACTTCGACTACTGGGGCCAGGGCACCCTGGTCACCGTGTC CAGC | 75 |
| FAP 28H1 VL | GAGATCGTGCTGACCCAGTCTCCCGGCACCCTGAGCCTGAGCC CTGGCGAGAGAGCCACCCTGAGCTGCAGAGCCAGCCAGAGCGT GAGCCGGAGCTACCTGGCCTGGTATCAGCAGAAGCCCGGCCAG GCCCCCAGACTGCTGATCATCGGCGCCAGCACCCGGGCCACCG GCATCCCCGATAGATTCAGCGGCAGCGGCTCCGGCACCGACTT CACCCTGACCATCAGCCGGCTGGAACCCGAGGACTTCGCCGTG TACTACTGCCAGCAGGGCCAGGTGATCCCCCCCACCTTCGGCC AGGGCACCAAGGTGGAAATCAAG | 76 |
| DP47 VH | GAGGTGCAATTGTTGGAGTCTGGGGGAGGCTTGGTACAGCCTG GGGGGTCCCTGAGACTCTCCTGTGCAGCCAGCGGATTCACCTT TAGCAGTTATGCCATGAGCTGGGTCCGCCAGGCTCCAGGGAAG GGGCTGGAGTGGGTCTCAGCTATTAGTGGTAGTGGTGGTAGCA CATACTACGCAGACTCCGTGAAGGGCCGGTTCACCATCTCCAG AGACAATTCCAAGAACACGCTGTATCTGCAGATGAACAGCCTG AGAGCCGAGGACACGGCCGTATATTACTGTGCGAAAGGCAGCG GATTTGACTACTGGGGCCAAGGAACCCTGGTCACCGTCTCGAG C | 77 |
| DP47 VL | GAAATTGTGCTGACCCAGAGCCCCGGCACCCTGTCACTGTCTC CAGGCGAAAGAGCCACCCTGAGCTGCAGAGCCAGCCAGAGCGT GTCCAGCTCTTACCTGGCCTGGTATCAGCAGAAGCCCGGACAG GCCCCCAGACTGCTGATCTACGGCGCCTCTTCTAGAGCCACCG GCATCCCCGATAGATTCAGCGGCAGCGGCTCCGGCACCGACTT CACCCTGACAATCAGCAGACTGGAACCCGAGGACTTTGCCGTG TATTACTGCCAGCAGTACGGCAGCAGCCCCCTGACCTTTGGCC AGGGCACCAAGGTGGAAATCAAA | 78 |
| mu CD40 VH | GAAGTGCAGCTGGTGGAATCCGACGGCGGACTGGTGCAGCCTG GCAGATCTCTGAAGCTGCCTTGTGCCGCCTCCGGCTTCACCTT CTCCGACTACTACATGGCTGGGTGCGACAGGCCCCTACCAAG GGACTGGAATGGGTGGCCTCCATCTCCTACGACGGCTCCTCCA CCTACTACCGGGACTCTGTGAAGGGCCGGTTCACCATCTCTCG GGACAACGCCAAGTCCACCCTGTACCTGCAGATGGACTCCCTG CGGAGCGAGGACACCGCTACCTACTACTGCGGCAGACACTCCT CCTACTTCGACTACTGGGGCCAGGGCGTGATGGTCACCGTGTC CTCT | 79 |
| mu CD40 VL | GACACTGTACTGACCCAGTCTCCTGCTTTGGCTGTGTCTCCAG GAGAGAGGGTTACCATCTCCTGTAGGGCCAGTGACAGTGTCAG TACACTTATGCACTGGTACCAACAGAAACCAGGACAGCAACCC AAACTCCTCATCTATCTAGCATCACACCTAGAATCTGGGGTCC | 80 |

TABLE 2-continued

Nucleotide sequences of the variable domains of the CD40 antibodies, the FAP antibody and DP47 antibody

| Description Sequence | Seq ID No |
|---|---|
| CTGCCAGGTTCAGTGGCAGTGGGTCTGGGACAGACTTCACCCT<br>CACCATTGATCCTGTGGAGGCTGATGACACTGCAACCTATTAC<br>TGTCAGCAGAGTTGGAATGATCCGTGGACGTTCGGTGGAGGCA<br>CCAAGCTGGAATTGAAA | |

TABLE 3

Amino acid sequences of the CD40 IgG and the bispecific antigen binding molecules

| Construct | Sequence | Seq ID No |
|---|---|---|
| P1AD4470 CD40 IgG | | |
| CD40 IgG Heavy chain | EVQLVESGGGLVQPGGSLRLSCAASGYSFTGYYIHWVRQAPGK<br>GLEWVARVIPNAGGTSYNQKFKGRFTLSVDNSKNTAYLQMNSL<br>RAEDTAVYYCAREGIYWWGQGTLVTVSSASTKGPSVFPLAPSS<br>KSTSGGTAALGCLVKDYFPEPVTVSWNSGALTSGVHTFPAVLQ<br>SSGLYSLSSVVTVPSSSLGTQTYICNVNHKPSNTKVDKKVEPK<br>SCDKTHTCPPCPAPELLGGPSVFLFPPKPKDTLMISRTPEVIC<br>VVVDVSHEDPEVKFNWYVDGVEVHNAKTKPREEQYNSTYRVVS<br>VLTVLHQDWLNGKEYKCKVSNKALPAPIEKTISKAKGQPREPQ<br>VYTLPPSREEMTKNQVSLTCLVKGFYPSDIAVEWESNGQPENN<br>YKTTPPVLDSDGSFFLYSKLTVDKSRWQQGNVFSCSVMHEALH<br>NHYTQKSLSLSPG | 81 |
| CD40 light chain | DIQMTQSPSSLSASVGDRVTITCRSSQSLVHSNGNTFLHWYQQ<br>KPGKAPKLLIYIVSNRFSGVPSRFSGSGSGTDFTLTISSLQPE<br>DFATYFCSQTTHVPWTFGQGTKVEIKRTVAAPSVFIFPPSDEQ<br>LKSGTASVVCLLNNFYPREAKVQWKVDNALQSGNSQESVTEQD<br>SKDSTYSLSSTLTLSKADYEKHKVYACEVTHQGLSSPVTKSFN<br>RGEC | 82 |
| P1AD4453 CD40 x FAP (28H1) (4 + 1) | | |
| CD40 VHCH1-<br>CD40 VHCH1-<br>Fc<br>knob_PGLALA-<br>28H1 VH | EVQLVESGGGLVQPGGSLRLSCAASGYSFTGYYIHWVRQAPGK<br>GLEWVARVIPNAGGTSYNQKFKGRFTLSVDNSKNTAYLQMNSL<br>RAEDTAVYYCAREGIYWWGQGTLVTVSSASTKGPSVFPLAPSS<br>KSTSGGTAALGCLVKDYFPEPVTVSWNSGALTSGVHTFPAVLQ<br>SSGLYSLSSVVTVPSSSLGTQTYICNVNHKPSNTKVDKKVEPK<br>SCDGGGGSGGGGSEVQLVESGGGLVQPGGSLRLSCAASGYSFT<br>GYYIHWVRQAPGKGLEWVARVIPNAGGTSYNQKFKGRFTLSVD<br>NSKNTAYLQMNSLRAEDTAVYYCAREGIYWWGQGTLVTVSSAS<br>TKGPSVFPLAPSSKSTSGGTAALGCLVKDYFPEPVTVSWNSGA<br>LTSGVHTFPAVLQSSGLYSLSSVVTVPSSSLGTQTYICNVNHK<br>PSNTKVDKKVEPKSCDKTHTCPPCPAPEAAGGPSVFLFPPKPK<br>DTLMISRIPEVTCVVVDVSHEDPEVKFNWYVDGVEVHNAKTKP<br>REEQYNSTYRVVSVLTVLHQDWLNGKEYKCKVSNKALGAPIEK<br>TISKAKGQPREPQVYTLPPCRDELTKNQVSLWCLVKGFYPSDI<br>AVEWESNGQPENNYKTTPPVLDSDGSFFLYSKLTVDKSRWQQG<br>NVFSCSVMHEALHNHYTQKSLSLSPGGGGSGGGGSGGGGSGG<br>GGSEVQLLESGGGLVQPGGSLRLSCAASGFTFSSHAMSWVRQA<br>PGKGLEWVSAIWASGEQYYADSVKGRFTISRDNSKNTLYLQMN<br>SLRAEDTAVYYCAKGWLGNFDYWGQGTLVTVSS | 83 |
| CD40 VHCH1-<br>CD40 VHCH1-<br>Fc<br>hole_PGLALA-<br>28H1 VL | EVQLVESGGGLVQPGGSLRLSCAASGYSFTGYYIHWVRQAPGK<br>GLEWVARVIPNAGGTSYNQKFKGRFTLSVDNSKNTAYLQMNSL<br>RAEDTAVYYCAREGIYWWGQGTLVTVSSASTKGPSVFPLAPSS<br>KSTSGGTAALGCLVKDYFPEPVTVSWNSGALTSGVHTFPAVLQ<br>SSGLYSLSSVVTVPSSSLGTQTYICNVNHKPSNTKVDKKVEPK<br>SCDGGGGSGGGGSEVQLVESGGGLVQPGGSLRLSCAASGYSFT<br>GYYIHWVRQAPGKGLEWVARVIPNAGGTSYNQKFKGRFTLSVD<br>NSKNTAYLQMNSLRAEDTAVYYCAREGIYWWGQGTLVTVSSAS<br>TKGPSVFPLAPSSKSTSGGTAALGCLVKDYFPEPVTVSWNSGA<br>LTSGVHTFPAVLQSSGLYSLSSVVTVPSSSLGTQTYICNVNHK<br>PSNTKVDKKVEPKSCDKTHTCPPCPAPEAAGGPSVFLFPPKPK<br>DTLMISRIPEVTCVVVDVSHEDPEVKFNWYVDGVEVHNAKTKP<br>REEQYNSTYRVVSVLTVLHQDWLNGKEYKCKVSNKALGAPIEK<br>TISKAKGQPREPQVCTLPPSRDELTKNQVSLSCAVKGFYPSDI<br>AVEWESNGQPENNYKTTPPVLDSDGSFFLVSKLTVDKSRWQQG | 84 |

TABLE 3-continued

Amino acid sequences of the CD40 IgG and the bispecific antigen binding molecules

| Construct | Sequence | Seq ID No |
|---|---|---|
| | NVFSCSVMHEALHNHYTQKSLSLSPGGGGGSGGGGSGGGGSGG<br>GGSEIVLTQSPGTLSLSPGERATLSCRASQSVSRSYLAWYQQK<br>PGQAPRLLIIGASTRATGIPDRFSGSGSGTDFILTISRLEPED<br>FAVYYCQQGQVIPPTFGQGTKVEIK | |
| CD40 light chain | DIQMTQSPSSLSASVGDRVTITCRSSQSLVHSNGNTFLHWYQQ<br>KPGKAPKLLIYTVSNRFSGVPSRFSGSGSGTDFILTISSLQPE<br>DFATYFCSQTTHVPWTFGQGTKVEIKRTVAAPSVFIFPPSDEQ<br>LKSGTASVVCLLNNFYPREAKVQWKVDNALQSGNSQESVTEQD<br>SKDSTYSLSSTLTLSKADYEKHKVYACEVTHQGLSSPVTKSFN<br>RGEC | 82 |

P1AD4455 CD40 x FAP (28H1) (4 + 2)

| Construct | Sequence | Seq ID No |
|---|---|---|
| CD40 VHCH1-<br>CD40 VHCH1-<br>Fc_PGLALA-<br>28H1 VLCH1<br>'EE' | EVQLVESGGGLVQPGGSLRLSCAASGYSFTGYYIHWVRQAPGK<br>GLEWVARVIPNAGGTSYNQKFKGRFTLSVDNSKNTAYLQMNSL<br>RAEDTAVYYCAREGIYWWGQGTLVTVSSASTKGPSVFPLAPSS<br>KSTSGGTAALGCLVEDYFPEPVTVSWNSGALTSGVHTFPAVLQ<br>SSGLYSLSSVVTVPSSSLGTQTYICNVNHKPSNTKVDEKVEPK<br>SCDGGGGSGGGGSEVQLVESGGGLVQPGGSLRLSCAASGYSFT<br>GYYIHWVRQAPGKGLEWVARVIPNAGGTSYNQKFKGRFTLSVD<br>NSKNTAYLQMNSLRAEDTAVYYCAREGIYWWGQGTLVTVSSAS<br>TKGPSVFPLAPSSKSTSGGTAALGCLVEDYFPEPVTVSWNSGA<br>LTSGVHTFPAVLQSSGLYSLSSVVTVPSSSLGTQTYICNVNHK<br>PSNTKVDEKVEPKSCDKTHTCPPCPAPEAAGGPSVFLFPPKPK<br>DTLMISRIPEVTCVVVDVSHEDPEVKFNWYVDGVEVHNAKTKP<br>REEQYNSTYRVVSVLTVLHQDWLNGKEYKCKVSNKALGAPIEK<br>TISKAKGQPREPQVYTLPPSRDELTKNQVSLTCLVKGFYPSDI<br>AVEWESNGQPENNYKTTPPVLDSDGSFFLYSKLTVDKSRWQQG<br>NVFSCSVMHEALHNHYTQKSLSLSPGGGGSGGGGSGGGGSGG<br>GGSEIVLTQSPGTLSLSPGERATLSCRASQSVSRSYLAWYQQK<br>PGQAPRLLIIGASTRATGIPDRFSGSGSGTDFTLTISRLEPED<br>FAVYYCQQGQVIPPTFGQGTKVEIKSSASTKGPSVFPLAPSSK<br>STSGGTAALGCLVKDYFPEPVTVSWNSGALTSGVHTFPAVLQS<br>SGLYSLSSVVTVPSSSLGTQTYICNVNHKPSNTKVDKKVEPKS<br>C | 85 |
| CD40-light chain; 'RK' | DIQMTQSPSSLSASVGDRVTITCRSSQSLVHSNGNTFLHWYQQ<br>KPGKAPKLLIYTVSNRFSGVPSRFSGSGSGTDFTLTISSLQPE<br>DFATYFCSQTTHVPWTFGQGTKVEIKRTVAAPSVFIFPPSDRK<br>LKSGTASVVCLLNNFYPREAKVQWKVDNALQSGNSQESVTEQD<br>SKDSTYSLSSTLTLSKADYEKHKVYACEVTHQGLSSPVTKSFN<br>RGEC | 86 |
| 28H1 VHCL | EVQLLESGGGLVQPGGSLRLSCAASGFTFSSHAMSWVRQAPGK<br>GLEWVSAIWASGEQYYADSVKGRFTISRDNSKNTLYLQMNSLR<br>AEDTAVYYCAKGWLGNFDYWGQGTLVTVSSASVAAPSVFIFPP<br>SDEQLKSGTASVVCLLNNFYPREAKVQWKVDNALQSGNSQESV<br>TEQDSKDSTYSLSSTLTLSKADYEKHKVYACEVTHQGLSSPVT<br>KSFNRGEC | 87 |

P1AA9641 CD40 x FAP (28H1) (2 + 1)

| Construct | Sequence | Seq ID No |
|---|---|---|
| CD40_Fc hole_PGLALA 28H1 VL | EVQLVESGGGLVQPGGSLRLSCAASGYSFTGYYIHWVRQAPGK<br>GLEWVARVIPNAGGTSYNQKFKGRFTLSVDNSKNTAYLQMNSL<br>RAEDTAVYYCAREGIYWWGQGTLVTVSSASTKGPSVFPLAPSS<br>KSTSGGTAALGCLVKDYFPEPVTVSWNSGALTSGVHTFPAVLQ<br>SSGLYSLSSVVTVPSSSLGTQTYICNVNHKPSNTKVDKKVEPK<br>SCDKTHTCPPCPAPEAAGGPSVFLFPPKPKDTLMISRTPEVIC<br>VVVDVSHEDPEVKFNWYVDGVEVHNAKTKPREEQYNSTYRVVS<br>VLTVLHQDWLNGKEYKCKVSNKALGAPIEKTISKAKGQPREPQ<br>VCTLPPSRDELTKNQVSLSCAVKGFYPSDIAVEWESNGQPENN<br>YKTTPPVLDSDGSFFLVSKLTVDKSRWQQGNVFSCSVMHEALH<br>NHYTQKSLSLSPGGGGSGGGGSGGGGSGGGGSEIVLTQSPGT<br>LSLSPGERATLSCRASQSVSRSYLAWYQQKPGQAPRLLIIGAS<br>TRATGIPDRFSGSGSGTDFTLTISRLEPEDFAVYYCQQGQVIP<br>PTFGQGTKVEIK | 88 |
| huCD40_Fc knob_PGLALA_ 28H1 VH | EVQLVESGGGLVQPGGSLRLSCAASGYSFTGYYIHWVRQAPGK<br>GLEWVARVIPNAGGTSYNQKFKGRFTLSVDNSKNTAYLQMNSL<br>RAEDTAVYYCAREGIYWWGQGTLVTVSSASTKGPSVFPLAPSS<br>KSTSGGTAALGCLVKDYFPEPVTVSWNSGALTSGVHTFPAVLQ<br>SSGLYSLSSVVTVPSSSLGTQTYICNVNHKPSNTKVDKKVEPK<br>SCDKTHTCPPCPAPEAAGGPSVFLFPPKPKDTLMISRTPEVIC | 89 |

TABLE 3-continued

Amino acid sequences of the CD40 IgG and the bispecific antigen binding molecules

| Construct | Sequence | Seq ID No |
|---|---|---|
| | VVVDVSHEDPEVKFNWYVDGVEVHNAKTKPREEQYNSTYRVVS VLTVLHQDWLNGKEYKCKVSNKALGAPIEKTISKAKGQPREPQ VYTLPPCRDELTKNQVSLWCLVKGFYPSDIAVEWESNGQPENN YKTTPPVLDSDGSFFLYSKLTVDKSRWQQGNVFSCSVMHEALH NHYTQKSLSLSPGGGGSGGGGSGGGGSGGGGSEVQLLESGGG LVQPGGSLRLSCAASGFTFSSHAMSWVRQAPGKGLEWVSAIWA SGEQYYADSVKGRFTISRDNSKNTLYLQMNSLRAEDTAVYYCA KGWLGNFDYWGQGTLVTVSS | |
| +CD40 LC | DIQMTQSPSSLSASVGDRVTITCRSSQSLVHSNGNTFLHWYQQ KPGKAPKLLIYTVSNRFSGVPSRFSGSGSGTDFTLTISSLQPE DFATYFCSQTTHVPWTFGQGTKVEIKRTVAAPSVFIFPPSDEQ LKSGTASVVCLLNNFYPREAKVQWKVDNALQSGNSQESVTEQD SKDSTYSLSSTLTLSKADYEKHKVYACEVTHQGLSSPVTKSFN RGEC | 82 |

P1AA9663 CD40 x FAP (28H1) (2 + 2)

| Construct | Sequence | Seq ID No |
|---|---|---|
| CD40-28H1 2 + 2; ,EE' huCD40- Fc_PGLALA_2 8H1_VLCH1 'EE' | EVQLVESGGGLVQPGGSLRLSCAASGYSFTGYYIHWVRQAPGK GLEWVARVIPNAGGTSYNQKFKGRFTLSVDNSKNTAYLQMNSL RAEDTAVYYCAREGIYWWGQGTLVTVSSASTKGPSVFPLAPSS KSTSGGTAALGCLVEDYFPEPVTVSWNSGALTSGVHTFPAVLQ SSGLYSLSSVVTVPSSSLGTQTYICNVNHKPSNTKVDEKVEPK SCDKTHTCPPCPAPEAAGGPSVFLFPPKPKDTLMISRTPEVTC VVVDVSHEDPEVKFNWYVDGVEVHNAKTKPREEQYNSTYRVVS VLTVLHQDWLNGKEYKCKVSNKALGAPIEKTISKAKGQPREPQ VYTLPPSRDELTKNQVSLTCLVKGFYPSDIAVEWESNGQPENN YKTTPPVLDSDGSFFLYSKLTVDKSRWQQGNVFSCSVMHEALH NHYTQKSLSLSPGGGGSGGGGSGGGGSGGGGSEIVLTQSPGT LSLSPGERATLSCRASQSVSRSYLAWYQQKPGQAPRLLIIGAS TRATGIPDRFSGSGSGTDFTLTISRLEPEDFAVYYCQQGQVIP PTFGQGTKVEIKSSASTKGPSVFPLAPSSKSTSGGTAALGCLV KDYFPEPVTVSWNSGALTSGVHTFPAVLQSSGLYSLSSVVTVP SSSLGTQTYICNVNHKPSNTKVDKKVEPKSC | 90 |
| +CD40 LC; ,RK' | DIQMTQSPSSLSASVGDRVTITCRSSQSLVHSNGNTFLHWYQQ KPGKAPKLLIYTVSNRFSGVPSRFSGSGSGTDFTLTISSLQPE DFATYFCSQTTHVPWTFGQGTKVEIKRTVAAPSVFIFPPSDRK LKSGTASVVCLLNNFYPREAKVQWKVDNALQSGNSQESVTEQD SKDSTYSLSSTLTLSKADYEKHKVYACEVTHQGLSSPVTKSFN RGEC | 86 |
| +28H1 VHCL | EVQLLESGGGLVQPGGSLRLSCAASGFTFSSHAMSWVRQAPGK GLEWVSAIWASGEQYYADSVKGRFTISRDNSKNTLYLQMNSLR AEDTAVYYCAKGWLGNFDYWGQGTLVTVSSASVAAPSVFIFPP SDEQLKSGTASVVCLLNNFYPREAKVQWKVDNALQSGNSQESV TEQDSKDSTYSLSSTLTLSKADYEKHKVYACEVTHQGLSSPVT KSFNRGEC | 87 |

P1AD4574 CD40 x DP47 (4 + 1)

| Construct | Sequence | Seq ID No |
|---|---|---|
| CD40 VHCH1- CD40 VHCH1- Fc knob_PGLALA- DP47 VH | EVQLVESGGGLVQPGGSLRLSCAASGYSFTGYYIHWVRQAPGK GLEWVARVIPNAGGTSYNQKFKGRFTLSVDNSKNTAYLQMNSL RAEDTAVYYCAREGIYWWGQGTLVTVSSASTKGPSVFPLAPSS KSTSGGTAALGCLVKDYFPEPVTVSWNSGALTSGVHTFPAVLQ SSGLYSLSSVVTVPSSSLGTQTYICNVNHKPSNTKVDKKVEPK SCDGGGGSGGGGSEVQLVESGGGLVQPGGSLRLSCAASGYSFT GYYIHWVRQAPGKGLEWVARVIPNAGGTSYNQKFKGRFTLSVD NSKNTAYLQMNSLRAEDTAVYYCAREGIYWWGQGTLVTVSSAS TKGPSVFPLAPSSKSTSGGTAALGCLVKDYFPEPVTVSWNSGA LTSGVHTFPAVLQSSGLYSLSSVVTVPSSSLGTQTYICNVNHK PSNTKVDKKVEPKSCDKTHTCPPCPAPEAAGGPSVFLFPPKPK DTLMISRIPEVTCVVVDVSHEDPEVKFNWYVDGVEVHNAKTKP REEQYNSTYRVVSVLTVLHQDWLNGKEYKCKVSNKALGAPIEK TISKAKGQPREPQVYTLPPCRDELTKNQVSLWCLVKGFYPSDI AVEWESNGQPENNYKTTPPVLDSDGSFFLYSKLTVDKSRWQQG NVFSCSVMHEALHNHYTQKSLSLSPGGGGSGGGGSGGGGSGG GGSEVQLLESGGGLVQPGGSLRLSCAASGFTFSSYAMSWVRQA PGKGLEWVSAISGSGGSTYYADSVKGRFTISRDNSKNTLYLQM NSLRAEDTAVYYCAKGSGFDYWGQGTLVTVSS | 91 |

TABLE 3-continued

Amino acid sequences of the CD40 IgG and the bispecific antigen binding molecules

| Construct | Sequence | Seq ID No |
|---|---|---|
| CD40 VHCH1-CD40 VHCH1-Fchole_PGLALA-DP47 VL | EVQLVESGGGLVQPGGSLRLSCAASGYSFTGYYIHWVRQAPGK GLEWVARVIPNAGGTSYNQKFKGRFTLSVDNSKNTAYLQMNSL RAEDTAVYYCAREGIYWWGQGTLVTVSSASTKGPSVFPLAPSS KSTSGGTAALGCLVKDYFPEPVTVSWNSGALTSGVHTFPAVLQ SSGLYSLSSVVTVPSSSLGTQTYICNVNHKPSNTKVDKKVEPK SCDGGGGSGGGGSEVQLVESGGGLVQPGGSLRLSCAASGYSFT GYYIHWVRQAPGKGLEWVARVIPNAGGTSYNQKFKGRFTLSVD NSKNTAYLQMNSLRAEDTAVYYCAREGIYWWGQGTLVTVSSAS TKGPSVFPLAPSSKSTSGGTAALGCLVKDYFPEPVTVSWNSGA LTSGVHTFPAVLQSSGLYSLSSVVTVPSSSLGTQTYICNVNHK PSNTKVDKKVEPKSCDKTHTCPPCPAPEAAGGPSVFLFPPKPK DTLMISRIPEVTCVVVDVSHEDPEVKFNWYVDGVEVHNAKTKP REEQYNSTYRVVSVLTVLHQDWLNGKEYKCKVSNKALGAPIEK TISKAKGQPREPQVCTLPPSRDELTKNQVSLSCAVKGFYPSDI AVEWESNGQPENNYKTTPPVLDSDGSFFLVSKLTVDKSRWQQG NVFSCSVMHEALHNHYTQKSLSLSPGGGGSGGGGSGGGGSGG GGSEIVLTQSPGTLSLSPGERATLSCRASQSVSSSYLAWYQQK PGQAPRLLIYGASSRATGIPDRFSGSGSGTDFTLTISRLEPED FAVYYCQQYGSSPLTFGQGTKVEIK | 92 |
| +CD40 light chain | DIQMTQSPSSLSASVGDRVTITCRSSQSLVHSNGNTFLHWYQQ KPGKAPKLLIYTVSNRFSGVPSRFSGSGSGTDFTLTISSLQPE DFATYFCSQTTHVPWTFGQGTKVEIKRTVAAPSVFIFPPSDEQ LKSGTASVVCLLNNFYPREAKVQWKVDNALQSGNSQESVTEQD SKDSTYSLSSTLTLSKADYEKHKVYACEVTHQGLSSPVTKSFN RGEC | 82 |

P1AD4465 CD40 x DP47 (4 + 2)

| Construct | Sequence | Seq ID No |
|---|---|---|
| CD40 VHCH1-CD40 VHCH1-Fc_PGLALA-DP47 VLCH1 'EE' | EVQLVESGGGLVQPGGSLRLSCAASGYSFTGYYIHWVRQAPGK GLEWVARVIPNAGGTSYNQKFKGRFTLSVDNSKNTAYLQMNSL RAEDTAVYYCAREGIYWWGQGTLVTVSSASTKGPSVFPLAPSS KSTSGGTAALGCLVEDYFPEPVTVSWNSGALTSGVHTFPAVLQ SSGLYSLSSVVTVPSSSLGTQTYICNVNHKPSNTKVDEKVEPK SCDGGGGSGGGGSEVQLVESGGGLVQPGGSLRLSCAASGYSFT GYYIHWVRQAPGKGLEWVARVIPNAGGTSYNQKFKGRFTLSVD NSKNTAYLQMNSLRAEDTAVYYCAREGIYWWGQGTLVTVSSAS TKGPSVFPLAPSSKSTSGGTAALGCLVEDYFPEPVTVSWNSGA LTSGVHTFPAVLQSSGLYSLSSVVTVPSSSLGTQTYICNVNHK PSNTKVDEKVEPKSCDKTHTCPPCPAPEAAGGPSVFLFPPKPK DTLMISRIPEVTCVVVDVSHEDPEVKFNWYVDGVEVHNAKTKP REEQYNSTYRVVSVLTVLHQDWLNGKEYKCKVSNKALGAPIEK TISKAKGQPREPQVYTLPPSRDELTKNQVSLTCLVKGFYPSDI AVEWESNGQPENNYKTTPPVLDSDGSFFLYSKLTVDKSRWQQG NVFSCSVMHEALHNHYTQKSLSLSPGGGGSGGGGSGGGGSGG GGSEIVLTQSPGTLSLSPGERATLSCRASQSVSSSYLAWYQQK PGQAPRLLIYGASSRATGIPDRFSGSGSGTDFTLTISRLEPED FAVYYCQQYGSSPLTFGQGTKVEIKSSASTKGPSVFPLAPSSK STSGGTAALGCLVKDYFPEPVTVSWNSGALTSGVHTFPAVLQS SGLYSLSSVVTVPSSSLGTQTYICNVNHKPSNTKVDKKVEPKS C | 93 |
| +CD40 light chain; 'RK' | DIQMTQSPSSLSASVGDRVTITCRSSQSLVHSNGNTFLHWYQQ KPGKAPKLLIYTVSNRFSGVPSRFSGSGSGTDFTLTISSLQPE DFATYFCSQTTHVPWTFGQGTKVEIKRTVAAPSVFIFPPSDRK LKSGTASVVCLLNNFYPREAKVQWKVDNALQSGNSQESVTEQD SKDSTYSLSSTLTLSKADYEKHKVYACEVTHQGLSSPVTKSFN RGEC | 86 |
| +DP47VHCL | EVQLLESGGGLVQPGGSLRLSCAASGFTFSSYAMSWVRQAPGK GLEWVSAISGSGGSTYYADSVKGRFTISRDNSKNTLYLQMNSL RAEDTAVYYCAKGSGFDYWGQGTLVTVSSASVAAPSVFIFPPS DEQLKSGTASVVCLLNNFYPREAKVQWKVDNALQSGNSQESVT EQDSKDSTYSLSSTLTLSKADYEKHKVYACEVTHQGLSSPVTK SFNRGEC | 94 |

TABLE 3-continued

Amino acid sequences of the CD40 IgG and the bispecific antigen binding molecules

| Construct | Sequence | Seq ID No |
|---|---|---|
| P1AD4520 or P1AD9139 mu CD40 (FGK4.5) x FAP (28H1) (4 + 1) | | |
| muCD40 VHCH1-muCD40 VHCH1-FcKK_DAPG-28H1 VH | EVQLVESDGGLVQPGRSLKLPCAASGFTFSDYYMAWVRQAPTK GLEWVASISYDGSSTYYRDSVKGRFTISRDNAKSTLYLQMDSL RSEDTATYYCGRHSSYFDYWGQGVMVTVSSAKTTPPSVYPLAP GSAAQTNSMVTLGCLVKGYFPEPVTVTWNSGSLSSGVHTFPAV LQSDLYTLSSSVTVPSSTWPSQTVTCNVAHPASSTKVDKKIVP RDCGGGGSGGGGSEVQLVESDGGLVQPGRSLKLPCAASGFTFS DYYMAWVRQAPTKGLEWVASISYDGSSTYYRDSVKGRFTISRD NAKSTLYLQMDSLRSEDTATYYCGRHSSYFDYWGQGVMVTVSS AKTTPPSVYPLAPGSAAQTNSMVTLGCLVKGYFPEPVTVTWNS GSLSSGVHTFPAVLQSDLYTLSSSVTVPSSTWPSQTVTCNVAH PASSTKVDKKIVPRDCGCKPCICTVPEVSSVFIFPPKPKDVLT ITLTPKVICVVVAISKDDPEVQFSWFVDDVEVHTAQTKPREEQ INSTFRSVSELPIMHQDWLNGKEFKCRVNSAAFGAPIEKTISK TKGRPKAPQVYTIPPPKKQMAKDKVSLTCMITNFFPEDITVEW QWNGQPAENYKNTQPIMKTDGSYFVYSKLNVQKSNWEAGNTFT CSVLHEGLHNHHTEKSLSHSPGGGGSGGGGSGGGGSGGGGSE VQLLESGGGLVQPGGSLRLSCAASGFTFSSHAMSWVRQAPGKG LEWVSAIWASGEQYYADSVKGRFTISRDNSKNTLYLQMNSLRA EDTAVYYCAKGWLGNFDYWGQGTLVTVSS | 95 |
| muCD40 VHCH1-muCD40 VHCH1-FcDD_DAPG-28H1 VL | EVQLVESDGGLVQPGRSLKLPCAASGFTFSDYYMAWVRQAPTK GLEWVASISYDGSSTYYRDSVKGRFTISRDNAKSTLYLQMDSL RSEDTATYYCGRHSSYFDYWGQGVMVTVSSAKTTPPSVYPLAP GSAAQTNSMVTLGCLVKGYFPEPVTVTWNSGSLSSGVHTFPAV LQSDLYTLSSSVTVPSSTWPSQTVTCNVAHPASSTKVDKKIVP RDCGGGGSGGGGSEVQLVESDGGLVQPGRSLKLPCAASGFTFS DYYMAWVRQAPTKGLEWVASISYDGSSTYYRDSVKGRFTISRD NAKSTLYLQMDSLRSEDTATYYCGRHSSYFDYWGQGVMVTVSS AKTTPPSVYPLAPGSAAQTNSMVTLGCLVKGYFPEPVTVTWNS GSLSSGVHTFPAVLQSDLYTLSSSVTVPSSTWPSQTVTCNVAH PASSTKVDKKIVPRDCGCKPCICTVPEVSSVFIFPPKPKDVLT ITLTPKVTCVVVAISKDDPEVQFSWFVDDVEVHTAQTKPREEQ INSTFRSVSELPIMHQDWLNGKEFKCRVNSAAFGAPIEKTISK TKGRPKAPQVYTIPPPKEQMAKDKVSLTCMITNFFPEDITVEW QWNGQPAENYDNTQPIMDTDGSYFVYSDLNVQKSNWEAGNTFT CSVLHEGLHNHHTEKSLSHSPGGGGSGGGGSGGGGSGGGGSE IVLTQSPGTLSLSPGERATLSCRASQSVSRSYLAWYQQKPGQA PRLLIIGASTRATGIPDRFSGSGSGTDFTLTISRLEPEDFAVY YCQQGQVIPPTFGQGTKVEIK | 96 |
| mu CD40 light chain | DTVLTQSPALAVSPGERVTISCRASDSVSTLMHWYQQKPGQQP KLLIYLASHLESGVPARFSGSGSGTDFTLTIDPVEADDTATYY CQQSWNDPWTFGGGTKLELKRADAAPTVSIFPPSSEQLTSGGA SVVCFLNNFYPKDINVKWKIDGSERQNGVLNSWTDQDSKDSTY SMSSTLTLTKDEYERHNSYTCEATHKTSTSPIVKSFNRNEC | 97 |
| P1AD4558 mu CD40 (FGK5.4) x FAP (28H1) (4 + 2) | | |
| muCD40 VHCH1-muCD40 VHCH1-Fc_DAPG-28H1 VLCH1 'EE' | EVQLVESDGGLVQPGRSLKLPCAASGFTFSDYYMAWVRQAPTK GLEWVASISYDGSSTYYRDSVKGRFTISRDNAKSTLYLQMDSL RSEDTATYYCGRHSSYFDYWGQGVMVTVSSAKTTPPSVYPLAP GSAAQTNSMVTLGCLVEGYFPEPVTVTWNSGSLSSGVHTFPAV LQSDLYTLSSSVTVPSSTWPSQTVTCNVAHPASSTKVDEKIVP RDCGGGGSGGGGSEVQLVESDGGLVQPGRSLKLPCAASGFTFS DYYMAWVRQAPTKGLEWVASISYDGSSTYYRDSVKGRFTISRD NAKSTLYLQMDSLRSEDTATYYCGRHSSYFDYWGQGVMVTVSS AKTTPPSVYPLAPGSAAQTNSMVTLGCLVEGYFPEPVTVTWNS GSLSSGVHTFPAVLQSDLYTLSSSVTVPSSTWPSQTVTCNVAH PASSTKVDEKIVPRDCGCKPCICTVPEVSSVFIFPPKPKDVLT ITLTPKVTCVVVAISKDDPEVQFSWFVDDVEVHTAQTKPREEQ INSTFRSVSELPIMHQDWLNGKEFKCRVNSAAFGAPIEKTISK TKGRPKAPQVYTIPPPKEQMAKDKVSLTCMITNFFPEDITVEW QWNGQPAENYKNTQPIMDTDGSYFVYSKLNVQKSNWEAGNTFT CSVLHEGLHNHHTEKSLSHSPGKGGGSGGGGSGGGGSGGGGS EIVLTQSPGTLSLSPGERATLSCRASQSVSRSYLAWYQQKPGQ APRLLIIGASTRATGIPDRFSGSGSGTDFTLTISRLEPEDFAV YYCQQGQVIPPTFGQGTKVEIKSSAKTTPPSVYPLAPGSAAQT NSMVTLGCLVKGYFPEPVTVTWNSGSLSSGVHTFPAVLQSDLY TLSSSVTVPSSTWPSQTVTCNVAHPASSTKVDKKIVPRDC | 98 |

TABLE 3-continued

Amino acid sequences of the CD40 IgG and the bispecific antigen binding molecules

| Construct | Sequence | Seq ID No |
|---|---|---|
| 28H1 VHCL (mu) | EVQLLESGGGLVQPGGSLRLSCAASGFTFSSHAMSWVRQAPGK GLEWVSAIWASGEQYYADSVKGRFTISRDNSKNTLYLQMNSLR AEDTAVYYCAKGWLGNFDYWGQGTLVTVSSASDAAPTVSIFPP SSEQLTSGGASVVCFLNNFYPKDINVKWKIDSERQNGVLNSW TDQDSKDSTYSMSSTLTLTKDEYERHNSYTCEATHKTSTSPTV KSFNRNEC | 99 |
| mu CD40 light chain; 'RK' | DTVLTQSPALAVSPGERVTISCRASDSVSTLMHWYQQKPGQQP KLLIYLASHLESGVPARFSGSGSGTDFTLTIDPVEADDTATYY CQQSWNDPWTFGGGTKLELKRADAAPTVSIFPPSSRKLTSGGA SVVCFLNNFYPKDINVKWKIDSERQNGVLNSWTDQDSKDSTY SMSSTLTLTKDEYERHNSYTCEATHKTSTSPIVKSFNRNEC | 100 |

P1AD4521 mu CD40-DP47 (4 + 1)

| Construct | Sequence | Seq ID No |
|---|---|---|
| muCD40 VHCH1-muCD40 VHCH1-FcKK_DAPG-DP47 VH | EVQLVESDGGLVQPGRSLKLPCAASGFTFSDYYMAWVRQAPTK GLEWVASISYDGSSTYYRDSVKGRFTISRDNAKSTLYLQMDSL RSEDTATYYCGRHSSYFDYWGQGVMVTVSSAKTTPPSVYPLAP GSAAQTNSMVTLGCLVKGYFPEPVTVTWNSGSLSSGVHTFPAV LQSDLYTLSSSVTVPSSTWPSQTVTCNVAHPASSTKVDKKIVP RDCGGGGSGGGGSEVQLVESDGGLVQPGRSLKLPCAASGFTFS DYYMAWVRQAPTKGLEWVASISYDGSSTYYRDSVKGRFTISRD NAKSTLYLQMDSLRSEDTATYYCGRHSSYFDYWGQGVMVTVSS AKTTPPSVYPLAPGSAAQTNSMVTLGCLVKGYFPEPVTVTWNS GSLSSGVHTFPAVLQSDLYTLSSSVTVPSSTWPSQTVTCNVAH PASSTKVDKKIVPRDCGCKPCICTVPEVSSVFIFPPKPKDVLT ITLTPKVTCVVVAISKDDPEVQFSWFVDDVEVHTAQTKPREEQ INSTFRSVSELPIMHQDWLNGKEFKCRVNSAAFGAPIEKTISK TKGRPKAPQVYTIPPPKKQMAKDKVSLTCMITNFFPEDITVEW QWNGQPAENYKNTQPIMKTDGSYFVYSKLNVQKSNWEAGNTFT CSVLHEGLHNHHTEKSLSHSPGGGGGSGGGGSGGGGSGGGGSE VQLLESGGGLVQPGGSLRLSCAASGFTFSSYAMSWVRQAPGKG LEWVSAISGSGGSTYYADSVKGRFTISRDNSKNTLYLQMNSLR AEDTAVYYCAKGSGFDYWGQGTLVTVSS | 101 |
| muCD40 VHCH1-muCD40 VHCH1-FcDD_DAPG-DP47 VL | EVQLVESDGGLVQPGRSLKLPCAASGFTFSDYYMAWVRQAPTK GLEWVASISYDGSSTYYRDSVKGRFTISRDNAKSTLYLQMDSL RSEDTATYYCGRHSSYFDYWGQGVMVTVSSAKTTPPSVYPLAP GSAAQTNSMVTLGCLVKGYFPEPVTVTWNSGSLSSGVHTFPAV LQSDLYTLSSSVTVPSSTWPSQTVTCNVAHPASSTKVDKKIVP RDCGGGGSGGGGSEVQLVESDGGLVQPGRSLKLPCAASGFTFS DYYMAWVRQAPTKGLEWVASISYDGSSTYYRDSVKGRFTISRD NAKSTLYLQMDSLRSEDTATYYCGRHSSYFDYWGQGVMVTVSS AKTTPPSVYPLAPGSAAQTNSMVTLGCLVKGYFPEPVTVTWNS GSLSSGVHTFPAVLQSDLYTLSSSVTVPSSTWPSQTVTCNVAH PASSTKVDKKIVPRDCGCKPCICTVPEVSSVFIFPPKPKDVLT ITLTPKVTCVVVAISKDDPEVQFSWFVDDVEVHTAQTKPREEQ INSTFRSVSELPIMHQDWLNGKEFKCRVNSAAFGAPIEKTISK TKGRPKAPQVYTIPPPKEQMAKDKVSLTCMITNFFPEDITVEW QWNGQPAENYDNTQPIMDTDGSYFVYSDLNVQKSNWEAGNTFT CSVLHEGLHNHHTEKSLSHSPGGGGGSGGGGSGGGGSGGGGSE IVLTQSPGTLSLSPGERATLSCRASQSVSSSYLAWYQQKPGQA PRLLIYGASSRATGIPDRFSGSGSGTDFTLTISRLEPEDFAVY YCQQYGSSPLTFGQGTKVEIK | 102 |
| +mu CD40 light chain | DTVLTQSPALAVSPGERVTISCRASDSVSTLMHWYQQKPGQQP KLLIYLASHLESGVPARFSGSGSGTDFTLTIDPVEADDTATYY CQQSWNDPWTFGGGTKLELKRADAAPTVSIFPPSSEQLTSGGA SVVCFLNNFYPKDINVKWKIDSERQNGVLNSWTDQDSKDSTY SMSSTLTLTKDEYERHNSYTCEATHKTSTSPIVKSFNRNEC | 97 |

P1AD4555 mu CD40-DP47 (4 + 2)

| Construct | Sequence | Seq ID No |
|---|---|---|
| muCD40 VHCH1-muCD40 VHCH1-Fc_DAPG-DP47 VLCH1 'EE' | EVQLVESDGGLVQPGRSLKLPCAASGFTFSDYYMAWVRQAPTK GLEWVASISYDGSSTYYRDSVKGRFTISRDNAKSTLYLQMDSL RSEDTATYYCGRHSSYFDYWGQGVMVTVSSAKTTPPSVYPLAP GSAAQTNSMVTLGCLVEGYFPEPVTVTWNSGSLSSGVHTFPAV LQSDLYTLSSSVTVPSSTWPSQTVTCNVAHPASSTKVDEKIVP RDCGGGGSGGGGSEVQLVESDGGLVQPGRSLKLPCAASGFTFS DYYMAWVRQAPTKGLEWVASISYDGSSTYYRDSVKGRFTISRD NAKSTLYLQMDSLRSEDTATYYCGRHSSYFDYWGQGVMVTVSS AKTTPPSVYPLAPGSAAQTNSMVTLGCLVEGYFPEPVTVTWNS GSLSSGVHTFPAVLQSDLYTLSSSVTVPSSTWPSQTVTCNVAH | 103 |

TABLE 3-continued

Amino acid sequences of the CD40 IgG and the bispecific antigen binding molecules

| Construct | Sequence | Seq ID No |
|---|---|---|
| | PASSTKVDEKIVPRDCGCKPCICTVPEVSSVFIFPPKPKDVLT<br>ITLTPKVICVVVAISKDDPEVQFSWFVDDVEVHTAQTKPREEQ<br>INSTFRSVSELPIMHQDWLNGKEFKCRVNSAAFGAPIEKTISK<br>TKGRPKAPQVYTIPPPKEQMAKDKVSLTCMITNFFPEDITVEW<br>QWNGQPAENYKNTQPIMDTDGSYFVYSKLNVQKSNWEAGNTFT<br>CSVLHEGLHNHHTEKSLSHSPGKGGGGSGGGGSGGGGSGGGGS<br>EIVLTQSPGTLSLSPGERATLSCRASQSVSSSYLAWYQQKPGQ<br>APRLLIYGASSRATGIPDRFSGSGSGTDFTLTISRLEPEDFAV<br>YYCQQYGSSPLTFGQGTKVEIKSSAKTTPPSVYPLAPGSAAQT<br>NSMVTLGCLVKGYFPEPVTVTWNSGSLSSGVHTFPAVLQSDLY<br>TLSSSVTVPSSTWPSQTVTCNVAHPASSTKVDKKIVPRDC | |
| +muCD40<br>light chain;<br>'RK' | DTVLTQSPALAVSPGERVTISCRASDSVSTLMHWYQQKPGQQP<br>KLLIYLASHLESGVPARFSGSGSGTDFTLTIDPVEADDTATYY<br>CQQSWNDPWTFGGGTKLELKRADAAPTVSIFPPSSRKLTSGGA<br>SVVCFLNNFYPKDINVKWKIDGSERQNGVLNSWTDQDSKDSTY<br>SMSSTLTLTKDEYERHNSYTCEATHKTSTSPIVKSFNRNEC | 100 |
| DP47 VHCL<br>(mu) | EVQLLESGGGLVQPGGSLRLSCAASGFTFSSYAMSWVRQAPGK<br>GLEWVSAISGSGGSTYYADSVKGRFTISRDNSKNTLYLQMNSL<br>RAEDTAVYYCAKGSGFDYWGQGTLVTVSSASDAAPTVSIFPPS<br>SEQLTSGGASVVCFLNNFYPKDINVKWKIDGSERQNGVLNSWT<br>DQDSKDSTYSMSSTLTLIKDEYERHNSYTCEATHKTSTSPIVK<br>SFNRNEC | 104 |

TABLE 4

Nucleotide sequences of the bispecific antigen binding molecules

| Construct | Sequence | Seq ID No |
|---|---|---|
| CD40 IgG<br>Heavy chain | GAGGTGCAGCTGGTGGAATCTGGCGGCGGACTGGTGCAGCCTG<br>GCGGATCTCTGAGACTGAGCTGTGCCGCCAGCGGCTACAGCTT<br>CACCGGCTACTACATCCACTGGGTGCGCCAGGCCCCTGGCAAG<br>GGACTGGAATGGGTGGCCAGAGTGATCCCCAATGCCGGCGGAA<br>CCAGCTACAACCAGAAGTTCAAGGGCCGGTTCACCCTGAGCGT<br>GGACAACAGCAAGAACACCGCCTACCTGCAGATGAACAGCCTG<br>CGGGCCGAGGACACCGCCGTGTACTATTGTGCCCGCGAGGGCA<br>TCTATTGGTGGGGCCAGGGAACACTCGTGACCGTGTCCAGCGC<br>TAGCACCAAGGGCCCAAGCGTGTTCCCACTGGCCCCAAGCAGC<br>AAGTCTACCAGCGGAGGAACAGCCGCCCTGGGATGTCTGGTGA<br>AGGACTACTTCCCCGAGCCAGTGACAGTGAGCTGGAACTCTGG<br>CGCCCTGACATCTGGCGTGCACACATTCCCAGCCGTGCTGCAG<br>TCTAGCGGCCTGTACAGCCTGTCCAGCGTGGTGACAGTGCCAA<br>GCAGCTCTCTGGGCACCCAGACCTACATCTGCAACGTGAACCA<br>CAAGCCCAGCAACACCAAGGTGGACAAGAAGGTGGAGCCCAAG<br>AGCTGCGACAAGACCCACACCTGCCCACCATGTCCAGCCCCAG<br>AGCTGCTGGGAGGACCTAGCGTGTTCCTGTTCCCCCCCAAGCC<br>AAAGGACACCCTGATGATCAGCAGAACCCCCGAGGTGACATGT<br>GTGGTGGTGGACGTGTCTCACGAGGACCCAGAGGTGAAGTTCA<br>ACTGGTACGTGGACGGAGTGGAGGTGCACAACGCCAAGACCAA<br>GCCCAGAGAGGAGCAGTACAACAGCACCTACCGCGTGGTGTCT<br>GTGCTGACAGTGCTGCACCAGGACTGGCTGAACGGCAAAGAAT<br>ACAAGTGCAAGGTCTCCAACAAGGCCCTGCCAGCCCCAATCGA<br>AAAGACCATCAGCAAGGCCAAGGGCCAGCCAAGGGAGCCACAG<br>GTGTACACCCTGCCCCCATCTAGGGAGGAGATGACCAAGAACC<br>AGGTCAGCCTGACCTGCCTGGTCAAAGGCTTCTATCCCAGCGA<br>CATCGCCGTGGAGTGGGAGAGCAATGGGCAGCCGGAGAACAAC<br>TACAAGACCACGCCTCCCGTGCTGGACTCCGACGGCTCCTTCT<br>TCCTCTACAGCAAGCTCACCGTGGACAAGAGCAGGTGGCAGCA<br>GGGGAACGTCTTCTCATGCTCCGTGATGCATGAGGCTCTGCAC<br>AACCACTACACGCAGAAGAGCCTCTCCCTGTCTCCGGGTAAA | 105 |
| CD40 light<br>chain | GACATCCAGATGACCCAGAGCCCCAGCAGCCTGTCTGCCAGCG<br>TGGGCGACAGAGTGACCATCACCTGTCGGAGCAGCCAGAGCCT<br>GGTGCACAGCAACGGCAACACCTTCCTGCACTGGTATCAGCAG<br>AAGCCCGGCAAGGCCCCCAAGCTGCTGATCTACACCGTGTCCA<br>ACCGGTTCAGCGGCGTGCCCAGCAGATTTCTGGCAGCGGCTC<br>CGGCACCGACTTCACCCTGACAATCAGCTCCCTGCAGCCCGAG | 106 |

TABLE 4-continued

Nucleotide sequences of the bispecific antigen binding molecules

| Construct | Sequence | Seq ID No |
|---|---|---|
| | GACTTCGCCACCTATTTCTGCAGCCAGACCACCCACGTGCCCT<br>GGACATTTGGACAGGGCACCAAGGTGGAAATCAAGCGTACGGT<br>GGCTGCACCATCTGTCTTCATCTTCCCGCCATCTGATGAGCAG<br>TTGAAATCTGGAACTGCCTCTGTTGTGTGCCTGCTGAATAACT<br>TCTATCCCAGAGAGGCCAAAGTACAGTGGAAGGTGGATAACGC<br>CCTCCAATCGGGTAACTCCCAGGAGAGTGTCACAGAGCAGGAC<br>AGCAAGGACAGCACCTACAGCCTCAGCAGCACCCTGACGCTGA<br>GCAAAGCAGACTACGAGAAACACAAAGTCTACGCCTGCGAAGT<br>CACCCATCAGGGCCTGAGCTCGCCCGTCACAAAGAGCTTCAAC<br>AGGGGAGAGTGT | |

CD40 × FAP (28H1) (4 + 1)

| Construct | Sequence | Seq ID No |
|---|---|---|
| CD40<br>VHCH1-CD40<br>VHCH1-<br>Fchole_PGLALA-<br>28H1 VH | GAGGTGCAGCTGGTGGAATCTGGCGGCGGACTGGTGCAGCCTG<br>GCGGATCTCTGAGACTGAGCTGTGCCGCCAGCGGCTACAGCTT<br>CACCGGCTACTACATCCACTGGGTGCGCCAGGCCCCTGGCAAG<br>GGACTGGAATGGGTGGCCAGAGTGATCCCCAATGCCGGCGGAA<br>CCAGCTACAACCAGAAGTTCAAGGGCCGGTTCACCCTGAGCGT<br>GGACAACAGCAAGAACACCGCCTACCTGCAGATGAACAGCCTG<br>CGGGCCGAGGACACCGCCGTGTACTATTGTGCCCGCGAGGGCA<br>TCTATTGGTGGGGCCAGGGAACACTCGTGACCGTGTCCAGCGC<br>TTCCACCAAGGGCCCTAGCGTGTTCCCTCTGGCCCCTAGCAGC<br>AAGTCTACCAGCGGAGGAACAGCCGCCCTGGGCTGCCTCGTGA<br>AGGACTACTTTCCCGAGCCCGTGACAGTGTCCTGGAACTCTGG<br>CGCCCTGACAAGCGGCGTGCACACCTTTCCAGCCGTGCTGCAG<br>AGCAGCGGCCTGTACTCTCTGAGCAGCGTCGTGACTGTGCCCA<br>GCAGCAGCCTGGGAACCCAGACCTACATCTGCAACGTGAACCA<br>CAAGCCCAGCAACACCAAGGTGGACAAGAAGGTGGAACCCAAG<br>AGCTGCGACGGCGGAGGCGGATCAGGCGGCGAGGATCCGAAG<br>TGCAGCTGGTGGAAAGTGGGGGAGGCCTGGTGCAGCAGGGGG<br>AAGCCTGAGACTGTCTTGTGCCGCTTCCGGCTACTCTTTTACC<br>GGGTATTATATCCATTGGGTGCGGCAGGCTCCAGGGAAAGGCC<br>TGGAATGGGTGGCACGCGTGATCCCTAACGCAGGCGGCACCTC<br>TTATAATCAGAAGTTTAAAGGGCGCTTTACCCTGTCCGTGGAC<br>AATTCCAAGAATACTGCTTACCTGCAGATGAATTCCCTGCGCG<br>CCGAAGATACAGCTGTGTATTACTGCGCCAGAGAAGGGATCTA<br>TTGGTGGGGACAGGGCACCCTCGTGACAGTGTCATCCGCTAGC<br>ACCAAGGGCCCATCGGTCTTCCCCCTGGCACCCTCCTCCAAGA<br>GCACCTCTGGGGGCACAGCGGCCCTGGGCTGCCTGGTCAAGGA<br>CTACTTCCCCGAACCGGTGACGGTGTCGTGGAACTCAGGCGCC<br>CTGACCAGCGGCGTGCACACCTTCCCGGCTGTCCTACAGTCCT<br>CAGGACTCTACTCCCTCAGCAGCGTGGTGACCGTGCCCTCCAG<br>CAGCTTGGGCACCCAGACCTACATCTGCAACGTGAATCACAAG<br>CCCAGCAACACCAAGGTGGACAAGAAAGTTGAGCCCAAATCTT<br>GTGACAAAACTCACACATGCCCACCGTGCCCAGCACCTGAAGC<br>TGCAGGGGGACCGTCAGTCTTCCTCTTCCCCCCAAAACCCAAG<br>GACACCCTCATGATCTCCCGGACCCCTGAGGTCACATGCGTGG<br>TGGTGGACGTGAGCCACGAAGACCCTGAGGTCAAGTTCAACTG<br>GTACGTGGACGGCGTGGAGGTGCATAATGCCAAGACAAAGCCG<br>CGGGAGGAGCAGTACAACAGCACGTACCGTGTGGTCAGCGTCC<br>TCACCGTCCTGCACCAGGACTGGCTGAATGGCAAGGAGTACAA<br>GTGCAAGGTCTCCAACAAAGCCCTCGGCGCCCCCATCGAGAAA<br>ACCATCTCCAAAGCCAAAGGGCAGCCCCGAGAACCACAGGTGT<br>ACACCCTGCCCCCCTGCAGAGATGAGCTGACCAAGAACCAGGT<br>GTCCCTGTGGTGTCTGGTCAAGGGCTTCTACCCCAGCGATATC<br>GCCGTGGAGTGGGAGAGCAACGGCCAGCCTGAGAACAACTACA<br>AGACCACCCCCCCTGTGCTGGACAGCGACGGCAGCTTCTTCCT<br>GTACTCCAAACTGACCGTGGACAAGAGCCGGTGGCAGCAGGGC<br>AACGTGTTCAGCTGCAGCGTGATGCACGAGGCCCTGCACAACC<br>ACTACACCCAGAAGTCCCTGAGCCTGAGCCCCGGCGGAGGCGG<br>CGGAAGCGGAGGAGGAGGATCCGGAGGAGGGGGAAGTGGCGGC<br>GGAGGATCTGAGGTGCAGCTGCTGGAATCCGGCGGAGGCCTGG<br>TGCAGCCTGGCGGATCTCTGAGACTGTCCTGCGCCGCCTCCGG<br>CTTCACCTTCTCCTCCCACGCCATGTCCTGGGTCCGACAGGCT<br>CCTGGCAAAGGCCTGGAATGGGTGTCCGCCATCTGGGCCTCCG<br>GCGAGCAGTACTACGCCGACTCTGTGAAGGGCCGGTTCACCAT<br>CTCCCGGGACAACTCCAAGAACACCCTGTACCTGCAGATGAAC<br>TCCCTGCGGGCCGAGGACACCGCCGTGTACTACTGTGCCAAGG<br>GCTGGCTGGGCAACTTCGACTACTGGGGCCAGGGCACCCTGGT<br>CACCGTGTCCAGC | 107 |

TABLE 4-continued

Nucleotide sequences of the bispecific antigen binding molecules

| Construct | Sequence | Seq ID No |
|---|---|---|
| CD40 VHCH1-CD40 VHCH1-Fchole_PGLALA-28H1 VL | GAGGTGCAGCTGGTGGAATCTGGCGGCGGACTGGTGCAGCCTG<br>GCGGATCTCTGAGACTGAGCTGTGCCGCCAGCGGCTACAGCTT<br>CACCGGCTACTACATCCACTGGGTGCGCCAGGCCCCTGGCAAG<br>GGACTGGAATGGGTGGCCAGAGTGATCCCCAATGCCGGCGGAA<br>CCAGCTACAACCAGAAGTTCAAGGGCCGGTTCACCCTGAGCGT<br>GGACAACAGCAAGAACACCGCCTACCTGCAGATGAACAGCCTG<br>CGGGCCGAGGACACCGCCGTGTACTATTGTGCCCGCGAGGGCA<br>TCTATTGGTGGGCCAGGGAACACTCGTGACCGTGTCCAGCGC<br>TTCCACCAAGGGCCCTAGCGTGTTCCCTCTGGCCCCTAGCAGC<br>AAGTCTACCAGCGGAGGAACAGCCGCCCTGGGCTGCCTCGTGA<br>AGGACTACTTTCCCGAGCCCGTGACAGTGTCCTGGAACTCTGG<br>CGCCCTGACAAGCGGCGTGCACACCTTTCCAGCCGTGCTGCAG<br>AGCAGCGGCCTGTACTCTCTGAGCAGCGTCGTGACTGTGCCCA<br>GCAGCAGCCTGGGAACCCAGACCTACATCTGCAACGTGAACCA<br>CAAGCCCAGCAACACCAAGGTGGACAAGAAGGTGGAACCCAAG<br>AGCTGCGACGGCGGAGGCGGATCAGGCGGCGGAGGATCCGAAG<br>TGCAGCTGGTGGAAAGTGGGGGAGGCCTGGTGCAGCCAGGGGG<br>AAGCCTGAGACTGTCTTGTGCCGCTTCCGGCTACTCTTTTACC<br>GGGTATTATATCCATTGGGTGCGGCAGGCTCCAGGGAAAGGCC<br>TGGAATGGGTGGCACGCGTGATCCCTAACGCAGGCGGCACCTC<br>TTATAATCAGAAGTTTAAAGGGCGCTTTACCCTGTCCGTGGAC<br>AATTCCAAGAATACTGCTTACCTGCAGATGAATTCCCTGCGCG<br>CCGAAGATACAGCTGTGTATTACTGCGCCAGAGAAGGGATCTA<br>TTGGTGGGGACAGGGCACCCTCGTGACAGTGTCATCCGCTAGC<br>ACCAAGGGCCCATCGGTCTTCCCCCTGGCACCCTCCTCCAAGA<br>GCACCTCTGGGGGCACAGCGGCCCTGGGCTGCCTGGTCAAGGA<br>CTACTTCCCCGAACCGGTGACGGTGTCGTGGAACTCAGGCGCC<br>CTGACCAGCGGCGTGCACACCTTCCCGGCTGTCCTACAGTCCT<br>CAGGACTCTACTCCCTCAGCAGCGTGGTGACCGTGCCCTCCAG<br>CAGCTTGGGCACCCAGACCTACATCTGCAACGTGAATCACAAG<br>CCCAGCAACACCAAGGTGGACAAGAAAGTTGAGCCCAAATCTT<br>GTGACAAAACTCACACATGCCCACCGTGCCCAGCACCTGAAGC<br>TGCAGGGGACCGTCAGTCTTCCTCTTCCCCCCAAAACCCAAG<br>GACACCCTCATGATCTCCCGGACCCCTGAGGTCACATGCGTGG<br>TGGTGGACGTGAGCCACGAAGACCCTGAGGTCAAGTTCAACTG<br>GTACGTGGACGGCGTGGAGGTGCATAATGCCAAGACAAAGCCG<br>CGGGAGGAGCAGTACAACAGCACGTACCGTGTGGTCAGCGTCC<br>TCACCGTCCTGCACCAGGACTGGCTGAATGGCAAGGAGTACAA<br>GTGCAAGGTCTCCAACAAAGCCCTCGGCGCCCCCATCGAGAAA<br>ACCATCTCCAAAGCCAAAGGGCAGCCCCGAGAACCACAGGTGT<br>GCACCCTGCCCCCATCCCGGGATGAGCTGACCAAGAACCAGGT<br>CAGCCTCTCGTGCGCAGTCAAAGGCTTCTATCCCAGCGACATC<br>GCCGTGGAGTGGGAGAGCAATGGGCAGCCGGAGAACAACTACA<br>AGACCACGCCTCCCGTGCTGGACTCCGACGGCTCCTTCTTCCT<br>CGTGAGCAAGCTCACCGTGGACAAGAGCAGGTGGCAGCAGGGG<br>AACGTCTTCTCATGCTCCGTGATGCATGAGGCTCTGCACAACC<br>ACTACACGCAGAAGAGCCTCTCCCTGTCTCCGGGTGGAGGCG<br>CGGAAGCGGAGGAGGAGGATCCGGTGGTGGCGGATCTGGGGGC<br>GGTGGATCTGAGATCGTGCTGACCCAGTCTCCCGGCACCCTGA<br>GCCTGAGCCCTGGCGAGAGAGCCACCCTGAGCTGCAGAGCCAG<br>CCAGAGCGTGAGCCGGAGCTACCTGGCCTGGTATCAGCAGAAG<br>CCCGGCCAGGCCCCCAGACTGCTGATCATCGGCGCCAGCACCC<br>GGGCCACCGGCATCCCCGATAGATTCAGCGGCAGCGGCTCCGG<br>CACCGACTTCACCCTGACCATCAGCCGGCTGGAACCCGAGGAC<br>TTCGCCGTGTACTACTGCCAGCAGGGCCAGGTGATCCCCCCCA<br>CCTTCGGCCAGGGCACCAAGGTGGAAATCAAG | 108 |
| CD40 light chain | see above | 106 |

CD40 × FAP (28H1) (4 + 2)

| Construct | Sequence | Seq ID No |
|---|---|---|
| CD40 VHCH1-CD40 VHCH1-Fc_PGLALA-28H1 VLCH1 'EE' | GAGGTGCAGCTGGTGGAATCTGGCGGCGGACTGGTGCAGCCTG<br>GCGGATCTCTGAGACTGAGCTGTGCCGCCAGCGGCTACAGCTT<br>CACCGGCTACTACATCCACTGGGTGCGCCAGGCCCCTGGCAAG<br>GGACTGGAATGGGTGGCCAGAGTGATCCCCAATGCCGGCGGAA<br>CCAGCTACAACCAGAAGTTCAAGGGCCGGTTCACCCTGAGCGT<br>GGACAACAGCAAGAACACCGCCTACCTGCAGATGAACAGCCTG<br>CGGGCCGAGGACACCGCCGTGTACTATTGTGCCCGCGAGGGCA<br>TCTATTGGTGGGCCAGGGAACACTCGTGACCGTGTCCAGCGC<br>TTCTACCAAGGGCCCCAGCGTGTTCCCTCTGGCCCCTAGCAGC<br>AAGAGCACATCTGGCGGAACAGCCGCCCTGGGCTGCCTCGTGG<br>AGGACTACTTTCCCGAGCCCGTGACAGTGTCCTGGAACTCTGG | 109 |

TABLE 4-continued

Nucleotide sequences of the bispecific antigen binding molecules

| Construct | Sequence | Seq ID No |
|---|---|---|
| | CGCCCTGACAAGCGGCGTGCACACCTTTCCAGCCGTGCTCCAG<br>AGCAGCGGCCTGTACTCTCTGAGCAGCGTCGTGACTGTGCCCA<br>GCAGCAGCCTGGGAACCCAGACCTACATCTGCAACGTGAACCA<br>CAAGCCCAGCAACACCAAGGTGGACGAGAAGGTGGAACCCAAG<br>AGCTGCGACGGCGGAGGCGGATCTGGCGGCGGAGGATCCGAAG<br>TGCAGCTGGTGGAAAGTGGGGGAGGCCTGGTGCAGCCAGGGGG<br>AAGCCTGAGACTGTCTTGTGCCGCTTCCGGCTACTCTTTTACC<br>GGGTATTATATCCATTGGGTGCGGCAGGCTCCAGGGAAAGGCC<br>TGGAATGGGTGGCACGCGTGATCCCTAACGCAGGCGGCACCTC<br>TTATAATCAGAAGTTTAAAGGGCGCTTTACCCTGTCCGTGGAC<br>AATTCCAAGAATACTGCTTACCTGCAGATGAATTCCCTGCGCG<br>CCGAAGATACAGCTGTGTATTACTGCGCCAGAGAAGGGATCTA<br>TTGGTGGGGACAGGGCACCCTCGTGACAGTGTCATCCGCTAGC<br>ACCAAGGGACCTTCCGTGTTTCCCCTGGCTCCCAGCTCCAAGT<br>CTACCTCTGGGGGCACAGCTGCTCTGGGATGTCTGGTGGAAGA<br>TTATTTTCCTGAACCTGTGACCGTGTCATGGAACAGCGGAGCC<br>CTGACCTCCGGGGTGCACACATTCCCTGCTGTGCTGCAGTCCT<br>CCGGCCTGTATAGCCTGAGCAGCGTCGTGACCGTGCCTTCCAG<br>CTCTCTGGGCACACAGACATATATCTGTAATGTGAATCACAAA<br>CCCTCTAATACCAAAGTGGATGAGAAAGTGGAACCTAAGTCCT<br>GCGACAAGACCCACACCTGTCCCCCTTGTCCTGCCCCTGAAGC<br>TGCTGGCGGCCCATCTGTGTTTCTGTTCCCCCCAAAGCCCAAG<br>GACACCCTGATGATCAGCCGGACCCCCGAAGTGACCTGCGTGG<br>TGGTGGATGTGTCCCACGAGGACCCAGAAGTGAAGTTCAATTG<br>GTACGTGGACGGCGTGGAAGTGCACAACGCCAAGACCAAGCCG<br>CGGGAAGAACAGTACAACAGCACCTACCGGGTGGTGTCCGTGC<br>TGACAGTGCTGCACCAGGACTGGCTGAACGGCAAAGAGTACAA<br>GTGCAAGGTGTCCAACAAGGCCCTGGGAGCCCCCATCGAGAAA<br>ACCATCAGCAAGGCCAAGGGCCAGCCCCGCGAACCTCAGGTGT<br>ACACCCTGCCCCCAAGCAGGGACGAGCTGACCAAGAACCAGGT<br>GTCCCTGACCTGTCTCGTGAAGGGCTTCTACCCCTCCGATATC<br>GCCGTGGAATGGGAGAGCAACGGCCAGCCCGAGAACAACTACA<br>AGACCACCCCCCCTGTGCTGGACAGCGACGGCTCATTCTTCCT<br>GTACTCCAAGCTGACCGTGGACAAGAGCCGGTGGCAGCAGGGC<br>AACGTGTTCAGCTGCAGCGTGATGCACGAGGCCCTGCACAACC<br>ACTACACACAGAAGTCTCTGAGCCTGAGCCCTGGCGGAGGGGG<br>AGGATCTGGGGGAGGCGGAAGTGGGGGAGGGGGTTCCGGAGGC<br>GGCGGATCAGAAATTGTGCTGACCCAGTCCCCCGGCACCCTGT<br>CACTGTCTCCAGGCGAAAGAGCCACCCTGAGCTGTAGGGCCTC<br>CCAGAGCGTGTCCAGAAGCTATCTGGCCTGGTATCAGCAGAAG<br>CCCGGACAGGCCCCCAGACTGCTGATCATTGGCGCCTCTACCA<br>GAGCCACCGGCATCCCCGATAGATTCAGCGGCTCTGGCAGCGG<br>CACCGACTTCACCCTGACCATCTCCAGACTGGAACCCGAGGAC<br>TTTGCCGTGTACTATTGCCAGCAGGGCCAAGTGATCCCCCCCA<br>CCTTTGGCCAGGGAACAAAGGTGGAAATCAAGTCCAGCGCTTC<br>CACCAAGGGCCCCTCAGTGTTCCCACTGGCACCATCCAGCAAG<br>TCCACAAGCGGAGGAACCGCCGCTCTGGGCTGTCTCGTGAAAG<br>ACTACTTTCCAGAGCCAGTGACCGTGTCCTGGAATAGTGGCGC<br>TCTGACTTCTGGCGTGCACACTTTCCCCGCAGTGCTGCAGAGT<br>CTGGCCTGTACTCCCTGAGTAGCGTCGTGACAGTGCCCTCCT<br>CTAGCCTGGGCACTCAGACTTACATCTGCAATGTGAATCATAA<br>GCCTTCCAACACAAAAGTGGACAAAAAAGTGGAACCCAAATCT<br>TGC | |
| CD40-light chain; ,RK` | GACATCCAGATGACCCAGAGCCCCAGCAGCCTGTCTGCCAGCG<br>TGGGCGACAGAGTGACCATCACCTGTCGGAGCAGCCAGAGCCT<br>GGT GCACAGCAACGGCAACACCTTCCTGCACTGGTATCAGCAG<br>AAGCCCGGCAAGGCCCCCAAGCTGCTGATCTACACCGTGTCCA<br>ACCGGTTCAGCGGCGTGCCCAGCAGATTTTCTGGCAGCGGCTC<br>CGGCACCGACTTCACCCTGACAATCAGCTCCCTGCAGCCCGAG<br>GACTTCGCCACCTATTTCTGCAGCCAGACCACCCACGTGCCCT<br>GGACATTTGGACAGGGCACCAAGGTGGAAATCAAGCGTACGGT<br>GGCTGCACCATCTGTCTTCATCTTCCCGCCATCTGATCGGAAG<br>TTGAAATCTGGAACTGCCTCTGTTGTGTGCCTGCTGAATAACT<br>TCTATCCCAGAGAGGCCAAAGTACAGTGGAAGGTGGATAACGC<br>CCTCCAATCGGGTAACTCCCAGGAGAGTGTCACAGAGCAGGAC<br>AGCAAGGACAGCACCTACAGCCTCAGCAGCACCCTGACGCTGA<br>GCAAAGCAGACTACGAGAAACACAAAGTCTACGCCTGCGAAGT<br>CACCCATCAGGGCCTGAGCTCGCCCGTCACAAAGAGCTTCAAC<br>AGGGGAGAGTGT | 110 |
| 28H1 VHCL | GAAGTGCAGCTGCTGGAATCCGGCGGAGGCCTGGTGCAGCCTG<br>GCGGATCTCTGAGACTGTCCTGCGCCGCCTCCGGCTTCACCTT<br>CTCCTCCCACGCCATGTCCTGGGTCCGACAGGCTCCTGGCAAA | 111 |

TABLE 4-continued

Nucleotide sequences of the bispecific antigen binding molecules

| Construct | Sequence | Seq ID No |
|---|---|---|
| | GGCCTGGAATGGGTGTCCGCCATCTGGGCCTCCGGCGAGCAGT<br>ACTACGCCGACTCTGTGAAGGGCCGGTTCACCATCTCCCGGGA<br>CAACTCCAAGAACACCCTGTACCTGCAGATGAACTCCCTGCGG<br>GCCGAGGACACCGCCGTGTACTACTGTGCCAAGGGCTGGCTGG<br>GCAACTTCGACTACTGGGGACAGGGCACCCTGGTCACCGTGTC<br>CAGCGCTAGCGTGGCCGCTCCCTCCGTGTTCATCTTCCCACCT<br>TCCGACGAGCAGCTGAAGTCCGGCACCGCTTCTGTCGTGTGCC<br>TGCTGAACAACTTCTACCCCCGCGAGGCCAAGGTGCAGTGGAA<br>GGTGGACAACGCCCTGCAGTCCGGCAACAGCCAGGAATCCGTG<br>ACCGAGCAGGACTCCAAGGACAGCACCTACTCCCTGTCCTCCA<br>CCCTGACCCTGTCCAAGGCCGACTACGAGAAGCACAAGGTGTA<br>CGCCTGCGAAGTGACCCACCAGGGCCTGTCTAGCCCCGTGACC<br>AAGTCTTTCAACCGGGGCGAGTGC | |

CD40 × FAP (28H1) (2 + 1)

| Construct | Sequence | Seq ID No |
|---|---|---|
| pETR17111<br>huCD40_Fchole_<br>PGLALA_<br>28H1 VL | GAGGTGCAGCTGGTGGAATCTGGCGGCGGACTGGTGCAGCCTG<br>GCGGATCTCTGAGACTGAGCTGTGCCGCCAGCGGCTACAGCTT<br>CACCGGCTACTACATCCACTGGGTGCGCCAGGCCCCTGGCAAG<br>GGACTGGAATGGGTGGCCAGAGTGATCCCCAATGCCGGCGGAA<br>CCAGCTACAACCAGAAGTTCAAGGGCCGGTTCACCCTGAGCGT<br>GGACAACAGCAAGAACACCGCCTACCTGCAGATGAACAGCCTG<br>CGGGCCGAGGACACCGCCGTGTACTATTGTGCCCGCGAGGGCA<br>TCTATTGGTGGGGCCAGGGAACACTCGTGACCGTGTCCAGCGC<br>TAGCACCAAGGGCCCATCGGTCTTCCCCCTGGCACCCTCCTCC<br>AAGAGCACCTCTGGGGGCACAGCGGCCCTGGGCTGCCTGGTCA<br>AGGACTACTTCCCCGAACCGGTGACGGTGTCGTGGAACTCAGG<br>CGCCCTGACCAGCGGCGTGCACACCTTCCCGGCTGTCCTACAG<br>TCCTCAGGACTCTACTCCCTCAGCAGCGTGGTGACCGTGCCCT<br>CCAGCAGCTTGGGCACCCAGACCTACATCTGCAACGTGAATCA<br>CAAGCCCAGCAACACCAAGGTGGACAAGAAAGTTGAGCCCAAA<br>TCTTGTGACAAAACTCACACATGCCCACCGTGCCCAGCACCTG<br>AAGCTGCAGGGGGACCGTCAGTCTTCCTCTTCCCCCCAAAACC<br>CAAGGACACCCTCATGATCTCCCGGACCCCTGAGGTCACATGC<br>GTGGTGGTGGACGTGAGCCACGAAGACCCTGAGGTCAAGTTCA<br>ACTGGTACGTGGACGGCGTGGAGGTGCATAATGCCAAGACAAA<br>GCCGCGGGAGGAGCAGTACAACAGCACGTACCGTGTGGTCAGC<br>GTCCTCACCGTCCTGCACCAGGACTGGCTGAATGGCAAGGAGT<br>ACAAGTGCAAGGTCTCCAACAAAGCCCTCGGCGCCCCCATCGA<br>GAAAACCATCTCCAAAGCCAAAGGGCAGCCCCGAGAACCACAG<br>GTGTGCACCCTGCCCCCATCCCGGGATGAGCTGACCAAGAACC<br>AGGTCAGCCTCTCGTGCGCAGTCAAAGGCTTCTATCCCAGCGA<br>CATCGCCGTGGAGTGGGAGAGCAATGGGCAGCCGGAGAACAAC<br>TACAAGACCACGCCTCCCGTGCTGGACTCCGACGGCTCCTTCT<br>TCCTCGTGAGCAAGCTCACCGTGGACAAGAGCAGGTGGCAGCA<br>GGGGAACGTCTTCTCATGCTCCGTGATGCATGAGGCTCTGCAC<br>AACCACTACACGCAGAAGAGCCTCTCCCTGTCTCCGGGTGGAG<br>GCGGCGGAAGCGGAGGAGGAGGATCCGGTGGTGGCGGATCTGG<br>GGGCGGTGGATCTGAGATCGTGCTGACCCAGTCTCCCGGCACC<br>CTGAGCCTGAGCCCTGGCGAGAGAGCCACCCTGAGCTGCAGAG<br>CCAGCCAGAGCGTGAGCCGGAGCTACCTGGCCTGGTATCAGCA<br>GAAGCCCGGCCAGGCCCCCAGACTGCTGATCATCGGCGCCAGC<br>ACCCGGGCCACCGGCATCCCCGATAGATTCAGCGGCAGCGGCT<br>CCGGCACCGACTTCACCCTGACCATCAGCCGGCTGGAACCCGA<br>GGACTTCGCCGTGTACTACTGCCAGCAGGGCCAGGTGATCCCC<br>CCCACCTTCGGCCAGGGCACCAAGGTGGAAATCAAGTGA | 112 |
| pETR17112<br>huCD40_Fcknob_<br>PGLALA_<br>28H1 VH | GAGGTGCAGCTGGTGGAATCTGGCGGCGGACTGGTGCAGCCTG<br>GCGGATCTCTGAGACTGAGCTGTGCCGCCAGCGGCTACAGCTT<br>CACCGGCTACTACATCCACTGGGTGCGCCAGGCCCCTGGCAAG<br>GGACTGGAATGGGTGGCCAGAGTGATCCCCAATGCCGGCGGAA<br>CCAGCTACAACCAGAAGTTCAAGGGCCGGTTCACCCTGAGCGT<br>GGACAACAGCAAGAACACCGCCTACCTGCAGATGAACAGCCTG<br>CGGGCCGAGGACACCGCCGTGTACTATTGTGCCCGCGAGGGCA<br>TCTATTGGTGGGGCCAGGGAACACTCGTGACCGTGTCCAGCGC<br>TAGCACCAAGGGCCCATCGGTCTTCCCCCTGGCACCCTCCTCC<br>AAGAGCACCTCTGGGGGCACAGCGGCCCTGGGCTGCCTGGTCA<br>AGGACTACTTCCCCGAACCGGTGACGGTGTCGTGGAACTCAGG<br>CGCCCTGACCAGCGGCGTGCACACCTTCCCGGCTGTCCTACAG<br>TCCTCAGGACTCTACTCCCTCAGCAGCGTGGTGACCGTGCCCT<br>CCAGCAGCTTGGGCACCCAGACCTACATCTGCAACGTGAATCA<br>CAAGCCCAGCAACACCAAGGTGGACAAGAAAGTTGAGCCCAAA<br>TCTTGTGACAAAACTCACACATGCCCACCGTGCCCAGCACCTG<br>AAGCTGCAGGGGGACCGTCAGTCTTCCTCTTCCCCCCAAAACC | 113 |

TABLE 4-continued

Nucleotide sequences of the bispecific antigen binding molecules

| Construct | Sequence | Seq ID No |
|---|---|---|
| | CAAGGACACCCTCATGATCTCCCGGACCCCTGAGGTCACATGC<br>GTGGTGGTGGACGTGAGCCACGAAGACCCTGAGGTCAAGTTCA<br>ACTGGTACGTGGACGGCGTGGAGGTGCATAATGCCAAGACAAA<br>GCCGCGGGAGGAGCAGTACAACAGCACGTACCGTGTGGTCAGC<br>GTCCTCACCGTCCTGCACCAGGACTGGCTGAATGGCAAGGAGT<br>ACAAGTGCAAGGTCTCCAACAAAGCCCTCGGCGCCCCCATCGA<br>GAAAACCATCTCCAAAGCCAAAGGGCAGCCCCGAGAACCACAG<br>GTGTACACCCTGCCCCCCTGCAGAGATGAGCTGACCAAGAACC<br>AGGTGTCCCTGTGGTGTCTGGTCAAGGGCTTCTACCCCAGCGA<br>TATCGCCGTGGAGTGGGAGAGCAACGGCCAGCCTGAGAACAAC<br>TACAAGACCACCCCCCCTGTGCTGGACAGCGACGGCAGCTTCT<br>TCCTGTACTCCAAACTGACCGTGGACAAGAGCCGGTGGCAGCA<br>GGGCAACGTGTTCAGCTGCAGCGTGATGCACGAGGCCCTGCAC<br>AACCACTACACCCAGAAGTCCCTGAGCCTGAGCCCCGGCGGAG<br>GCGGCGGAAGCGGAGGAGGAGGATCCGGAGGAGGGGGAAGTGG<br>CGGCGGAGGATCTGAGGTGCAGCTGCTGGAATCCGGCGGAGGC<br>CTGGTGCAGCCTGGCGGATCTCTGAGACTGTCCTGCGCCGCCT<br>CCGGCTTCACCTTCTCCTCCCACGCCATGTCCTGGGTCCGACA<br>GGCTCCTGGCAAAGGCCTGGAATGGGTGTCCGCCATCTGGGCC<br>TCCGGCGAGCAGTACTACGCCGACTCTGTGAAGGGCCGGTTCA<br>CCATCTCCCGGGACAACTCCAAGAACACCCTGTACCTGCAGAT<br>GAACTCCCTGCGGGCCGAGGACACCGCCGTGTACTACTGTGCC<br>AAGGGCTGGCTGGGCAACTTCGACTACTGGGGCCAGGGCACCC<br>TGGTCACCGTGTCCAGCTGA | |
| +CD40 LC<br>pETR15390 | see above | 106 |

CD40 x FAP (28H1) (2 + 2)

| | | |
|---|---|---|
| pETR17113<br>huCD40-<br>Fc_PGLALA_<br>28H1 VLCH1<br>'EE' | GAGGTGCAGCTGGTGGAATCTGGCGGCGGACTGGTGCAGCCTG<br>GCGGATCTCTGAGACTGAGCTGTGCCGCCAGCGGCTACAGCTT<br>CACCGGCTACTACATCCACTGGGTGCGCCAGGCCCCTGGCAAG<br>GGACTGGAATGGGTGGCCGAGAGTGATCCCCAATGCCGGCGGAA<br>CCAGCTACAACCAGAAGTTCAAGGGCCGGTTCACCCTGAGCGT<br>GGACAACAGCAAGAACACCGCCTACCTGCAGATGAACAGCCTG<br>CGGGCCGAGGACACCGCCGTGTACTATTGTGCCCGCGAGGGCA<br>TCTATTGGTGGGGCCAGGGAACACTCGTGACCGTGTCCAGCGC<br>TAGCACCAAGGGACCTTCCGTGTTTCCCCTGGCTCCCAGCTCC<br>AAGTCTACCTCTGGGGGCACAGCTGCTCTGGGATGTCTGGTGG<br>AAGATTATTTTCCTGAACCTGTGACCGTGTCATGGAACAGCGG<br>AGCCCTGACCTCCGGGGTGCACACATTCCCTGCTGTGCTGCAG<br>TCCTCCGGCCTGTATAGCCTGAGCAGCGTCGTGACCGTGCCTT<br>CCAGCTCTCTGGGCACACAGACATATATCTGTAATGTGAATCA<br>CAAACCCTCTAATACCAAAGTGGATGAGAAAGTGGAACCTAAG<br>TCCTGCGACAAGACCCACACCTGTCCCCCTTGTCCTGCCCCTG<br>AAGCTGCTGGCGGCCCATCTGTGTTTCTGTTCCCCCCAAAGCC<br>CAAGGACACCCTGATGATCAGCCGGACCCCCGAAGTGACCTGC<br>GTGGTGGTGGATGTGTCCCACGAGGACCCAGAAGTGAAGTTCA<br>ATTGGTACGTGGACGGCGTGGAAGTGCACAACGCCAAGACCAA<br>GCCGCGGGAAGAACAGTACAACAGCACCTACCGGGTGGTGTCC<br>GTGCTGACAGTGCTGCACCAGGACTGGCTGAACGGCAAAGAGT<br>ACAAGTGCAAGGTGTCCAACAAGGCCCTGGGAGCCCCCATCGA<br>GAAAACCATCAGCAAGGCCAAGGGCCAGCCCCGCGAACCTCAG<br>GTGTACACCCTGCCCCCAAGCAGGGACGAGCTGACCAAGAACC<br>AGGTGTCCCTGACCTGTCTCGTGAAGGGCTTCTACCCCTCCGA<br>TATCGCCGTGGAATGGGAGAGCAACGGCCAGCCCGAGAACAAC<br>TACAAGACCACCCCCCCTGTGCTGGACAGCGACGGCTCATTCT<br>TCCTGTACTCCAAGCTGACCGTGGACAAGAGCCGGTGGCAGCA<br>GGGCAACGTGTTCAGCTGCAGCGTGATGCACGAGGCCCTGCAC<br>AACCACTACACACAGAAGTCTCTGAGCCTGAGCCCTGGCGGAG<br>GGGGAGGATCTGGGGGAGGCGAAGTGGGGGAGGGGTTCCGG<br>AGGCGGCGGATCAGAAATTGTGCTGACCCAGTCCCCCGGCACC<br>CTGTCACTGTCTCCAGGCGAAAGAGCCACCCTGAGCTGTAGGG<br>CCTCCCAGAGCGTGTCCAGAAGCTATCTGGCCTGGTATCAGCA<br>GAAGCCCGGACAGGCCCCCAGACTGCTGATCATTGGCGCCTCT<br>ACCAGAGCCACCGGCATCCCCGATAGATTCAGCGGCTCTGGCA<br>GCGGCACCGACTTCACCCTGACCATCTCCAGACTGGAACCCGA<br>GGACTTTGCCGTGTACTATTGCCAGCAGGGCCAAGTGATCCCC<br>CCCACCTTTGGCCAGGGAACAAAGGTGGAAATCAAGTCCAGCG<br>CTTCCACCAAGGGCCCCTCAGTGTTCCCACTGGCACCATCCAG<br>CAAGTCCACAAGCGGAGGAACCGCCGCTCTGGGCTGTCTCGTG<br>AAAGACTACTTTCCAGAGCCAGTGACCGTGTCCTGGAATAGTG<br>GCGCTCTGACTTCTGGCGTGCACACTTTCCCCGCAGTGCTGCA | 114 |

TABLE 4-continued

Nucleotide sequences of the bispecific antigen binding molecules

| Construct | Sequence | Seq ID No |
|---|---|---|
| | GAGTTCTGGCCTGTACTCCCTGAGTAGCGTCGTGACAGTGCCC TCCTCTAGCCTGGGCACTCAGACTTACATCTGCAATGTGAATC ATAAGCCTTCCAACACAAAAGTGGACAAAAAAGTGGAACCCAA ATCTTGCTGA | |
| +CD40 LC; ,RK' pETR15391 | see above | 110 |
| +28H1 VHCL pETR15114 | see above | 111 |

CD40 x DP47 (4 + 1)

| | | |
|---|---|---|
| CD40 VHCH1-CD40 VHCH1- Fcknob_PGLALA- DP47 VH | GAGGTGCAGCTGGTGGAATCTGGCGGCGGACTGGTGCAGCCTG GCGGATCTCTGAGACTGAGCTGTGCCGCCAGCGGCTACAGCTT CACCGGCTACTACATCCACTGGGTGCGCCAGGCCCCTGGCAAG GGACTGGAATGGGTGGCCAGAGTGATCCCCAATGCCGGCGGAA CCAGCTACAACCAGAAGTTCAAGGGCCGGTTCACCCTGAGCGT GGACAACAGCAAGAACACCGCCTACCTGCAGATGAACAGCCTG CGGGCCGAGGACACCGCCGTGTACTATTGTGCCCGCGAGGGCA TCTATTGGTGGGGCCAGGGAACACTCGTGACCGTGTCCAGCGC TTCCACCAAGGGCCCTAGCGTGTTCCCTCTGGCCCCTAGCAGC AAGTCTACCAGCGGAGGAACAGCCGCCCTGGGCTGCCTCGTGA AGGACTACTTTCCCGAGCCCGTGACAGTGTCCTGGAACTCTGG CGCCCTGACAAGCGGCGTGCACACCTTTCCAGCCGTGCTGCAG AGCAGCGGCCTGTACTCTCTGAGCAGCGTCGTGACTGTGCCCA GCAGCAGCCTGGGAACCCAGACCTACATCTGCAACGTGAACCA CAAGCCCAGCAACACCAAGGTGGACAAGAAGGTGGAACCCAAG AGCTGCGACGGCGGAGGCGGATCAGGCGGCGAGGATCCGAAG TGCAGCTGGTGGAAAGTGGGGGAGGCCTGGTGCAGCCAGGGGG AAGCCTGAGACTGTCTTGTGCCGCTTCCGGCTACTCTTTTACC GGGTATTATATCCATTGGGTGCGGCAGGCTCCAGGGAAAGGCC TGGAATGGGTGGCACGCGTGATCCCTAACGCAGGCGGCACCTC TTATAATCAGAAGTTTAAAGGGCGCTTTACCCTGTCCGTGGAC AATTCCAAGAATACTGCTTACCTGCAGATGAATTCCCTGCGCG CCGAAGATACAGCTGTGTATTACTGCGCCAGAGAAGGGATCTA TTGGTGGGGACAGGGCACCCTCGTGACAGTGTCATCCGCTAGC ACCAAGGGCCCATCGGTCTTCCCCCTGGCACCCTCCTCCAAGA GCACCTCTGGGGGCACAGCGGCCCTGGGCTGCCTGGTCAAGGA CTACTTCCCCGAACCGGTGACGGTGTCGTGGAACTCAGGCGCC CTGACCAGCGGCGTGCACACCTTCCCGGCTGTCCTACAGTCCT CAGGACTCTACTCCCTCAGCAGCGTGGTGACCGTGCCCTCCAG CAGCTTGGGCACCCAGACCTACATCTGCAACGTGAATCACAAG CCCAGCAACACCAAGGTGGACAAGAAAGTTGAGCCCAAATCTT GTGACAAAACTCACACATGCCCACCGTGCCCAGCACCTGAAGC TGCAGGGGGACCGTCAGTCTTCCTCTTCCCCCCAAAACCCAAG GACACCCTCATGATCTCCCGGACCCCTGAGGTCACATGCGTGG TGGTGGACGTGAGCCACGAAGACCCTGAGGTCAAGTTCAACTG GTACGTGGACGGCGTGGAGGTGCATAATGCCAAGACAAAGCCG CGGGAGGAGCAGTACAACAGCACGTACCGTGTGGTCAGCGTCC TCACCGTCCTGCACCAGGACTGGCTGAATGGCAAGGAGTACAA GTGCAAGGTCTCCAACAAAGCCCTCGGCGCCCCCATCGAGAAA ACCATCTCCAAAGCCAAAGGGCAGCCCCGAGAACCACAGGTGT ACACCCTGCCCCCCTGCAGAGATGAGCTGACCAAGAACCAGGT GTCCCTGTGGTGTCTGGTCAAGGGCTTCTACCCCAGCGATATC GCCGTGGAGTGGGAGAGCAACGGCCAGCCTGAGAACAACTACA AGACCACCCCCCCTGTGCTGGACAGCGACGGCAGCTTCTTCCT GTACTCCAAACTGACCGTGGACAAGAGCCGGTGGCAGCAGGGC AACGTGTTCAGCTGCAGCGTGATGCACGAGGCCCTGCACAACC ACTACACCCAGAAGTCCCTGAGCCTGAGCCCCGGCGGAGGCGG CGGAAGCGGAGGAGGAGGATCCGGAGGAGGGGGAAGTGGCGGC GGAGGATCTGAGGTGCAATTGTTGGAGTCTGGGGGAGGCTTGG TACAGCCTGGGGGGTCCCTGAGACTCTCCTGTGCAGCCAGCGG ATTCACCTTTAGCAGTTATGCCATGAGCTGGGTCCGCCAGGCT CCAGGGAAGGGGCTGGAGTGGGTCTCAGCTATTAGTGGTAGTG GTGGTAGCACATACTACGCAGACTCCGTGAAGGGCCGGTTCAC CATCTCCAGAGACAATTCCAAGAACACGCTGTATCTGCAGATG AACAGCCTGAGAGCCGAGGACACGGCCGTATATTACTGTGCGA AAGGCAGCGGATTTGACTACTGGGGCCAAGGAACCCTGGTCAC CGTCTCGAGC | 115 |

TABLE 4-continued

Nucleotide sequences of the bispecific antigen binding molecules

| Construct | Sequence | Seq ID No |
|---|---|---|
| CD40 VHCH1-CD40 VHCH1-Fc hole_PGLALA-DP47 VL | GAGGTGCAGCTGGTGGAGAGCGGCGGCGGCCTGGTGCAGCCCG GCGGCAGCCTGAGGCTGAGCTGCGCCGCCAGCGGCTACAGCTT CACCGGCTACTACATCCACTGGGTGAGGCAGGCCCCCGGCAAG GGCCTGGAGTGGGTGGCCAGGGTGATCCCCAACGCCGGCGGCA CCAGCTACAACCAGAAGTTCAAGGGCAGGTTCACCCTGAGCGT GGACAACAGCAAGAACACCGCCTACCTGCAGATGAACAGCCTG AGGGCCGAGGACACCGCCGTGTACTACTGCGCCAGGGAGGGCA TCTACTGGTGGGGCCAGGGCACCCTGGTGACCGTGAGCAGCGC CAGCACCAAGGGCCCCAGCGTGTTCCCCCTGGCCCCCAGCAGC AAGAGCACCAGCGGCGGCACCGCCGCCCTGGGCTGCCTGGTGA AGGACTACTTCCCCGAGCCCGTGACCGTGAGCTGGAACAGCGG CGCCCTGACCAGCGGCGTGCACACCTTCCCCGCCGTGCTGCAG AGCAGCGGCCTGTACAGCCTGAGCAGCGTGGTGACCGTGCCCA GCAGCAGCCTGGGCACCCAGACCTACATCTGCAACGTGAACCA CAAGCCCAGCAACACCAAGGTGGACAAGAAGGTGGAGCCCAAG AGCTGCGACGGCGGCGGCGGCAGCGGCGGCGGCGGCAGCGAGG TGCAGCTGGTGGAGAGCGGCGGCGGCCTGGTGCAGCCCGGCGG CAGCCTGAGGCTGAGCTGCGCCGCCAGCGGCTACAGCTTCACC GGCTACTACATCCACTGGGTGAGGCAGGCCCCCGGCAAGGGCC TGGAGTGGGTGGCCAGGGTGATCCCCAACGCCGGCGGCACCAG CTACAACCAGAAGTTCAAGGGCAGGTTCACCCTGAGCGTGGAC AACAGCAAGAACACCGCCTACCTGCAGATGAACAGCCTGAGGG CCGAGGACACCGCCGTGTACTACTGCGCCAGGGAGGGCATCTA CTGGTGGGGCCAGGGCACCCTGGTGACCGTGAGCAGCGCCAGC ACCAAGGGCCCCAGCGTGTTCCCCCTGGCCCCCAGCAGCAAGA GCACCAGCGGCGGCACCGCCGCCCTGGGCTGCCTGGTGAAGGA CTACTTCCCCGAGCCCGTGACCGTGAGCTGGAACAGCGGCGCC CTGACCAGCGGCGTGCACACCTTCCCCGCCGTGCTGCAGAGCA GCGGCCTGTACAGCCTGAGCAGCGTGGTGACCGTGCCCAGCAG CAGCCTGGGCACCCAGACCTACATCTGCAACGTGAACCACAAG CCCAGCAACACCAAGGTGGACAAGAAGGTGGAGCCCAAGAGCT GCGACAAGACCCACACCTGCCCCCCCTGCCCCGCCCCCGAGGC CGCCGGCGGCCCCAGCGTGTTCCTGTTCCCCCCCAAGCCCAAG GACACCCTGATGATCAGCAGGACCCCCGAGGTGACCTGCGTGG TGGTGGACGTGAGCCACGAGGACCCCGAGGTGAAGTTCAACTG GTACGTGGACGGCGTGGAGGTGCACAACGCCAAGACCAAGCCC AGGGAGGAGCAGTACAACAGCACCTACAGGGTGGTGAGCGTGC TGACCGTGCTGCACCAGGACTGGCTGAACGGCAAGGAGTACAA GTGCAAGGTGAGCAACAAGGCCCTGGGCGCCCCCATCGAGAAG ACCATCAGCAAGGCCAAGGGCCAGCCCAGGGAGCCCCAGGTGT GCACCCTGCCCCCCAGCAGGGACGAGCTGACCAAGAACCAGGT GAGCCTGAGCTGCGCCGTGAAGGGCTTCTACCCCAGCGACATC GCCGTGGAGTGGGAGAGCAACGGCCAGCCCGAGAACAACTACA AGACCACCCCCCCCGTGCTGGACAGCGACGGCAGCTTCTTCCT GGTGAGCAAGCTGACCGTGGACAAGAGCAGGTGGCAGCAGGGC AACGTGTTCAGCTGCAGCGTGATGCACGAGGCCCTGCACAACC ACTACACCCAGAAGAGCCTGAGCCTGAGCCCCGGCGGCGCGG CGGCAGCGGCGGCGGCGGCAGCGGCGGCGGCGGCAGCGGCGGC GGCGGCAGCGAGATCGTGCTGACCCAGAGCCCCGGCACCCTGA GCCTGAGCCCCGGCGAGAGGGCCACCCTGAGCTGCAGGGCCAG CCAGAGCGTGAGCAGCAGCTACCTGGCCTGGTACCAGCAGAAG CCCGGCCAGGCCCCCAGGCTGCTGATCTACGGCGCCAGCAGCA GGGCCACCGGCATCCCCGACAGGTTCAGCGGCAGCGGCAGCGG CACCGACTTCACCCTGACCATCAGCAGGCTGGAGCCCGAGGAC TTCGCCGTGTACTACTGCCAGCAGTACGGCAGCAGCCCCCTGA CCTTCGGCCAGGGCACCAAGGTGGAGATCAAG | 116 |
| +CD40 LC pETR15390 | see above | 106 |

CD40 x DP47 (4 + 2)

| Construct | Sequence | Seq ID No |
|---|---|---|
| CD40 VHCH1-CD40 VHCH1-Fc_PGLALA-DP47 VLCH1 'EE' | GAGGTGCAGCTGGTGGAATCTGGCGGCGGACTGGTGCAGCCTG GCGGATCTCTGAGACTGAGCTGTGCCGCCAGCGGCTACAGCTT CACCGGCTACTACATCCACTGGGTGCGCCAGGCCCCTGGCAAG GGACTGGAATGGGTGGCCAGAGTGATCCCCAATGCCGGCGGAA CCAGCTACAACCAGAAGTTCAAGGGCCGGTTCACCCTGAGCGT GGACAACAGCAAGAACACCGCCTACCTGCAGATGAACAGCCTG CGGGCCGAGGACACCGCCGTGTACTATTGTGCCCGCGAGGGCA TCTATTGGTGGGCCAGGGAACACTCGTGACCGTGTCCAGCGC TTCTACCAAGGGCCCCAGCGTGTTCCCTCTGGCCCCTAGCAGC AAGAGCACATCTGGCGGAACAGCCGCCCTGGGCTGCCTCGTGG AGGACTACTTTCCCGAGCCCGTGACAGTGTCCTGGAACTCTGG | 117 |

TABLE 4-continued

Nucleotide sequences of the bispecific antigen binding molecules

| Construct | Sequence | Seq ID No |
|---|---|---|
| | CGCCCTGACAAGCGGCGTGCACACCTTTCCAGCCGTGCTCCAG<br>AGCAGCGGCCTGTACTCTCTGAGCAGCGTCGTGACTGTGCCCA<br>GCAGCAGCCTGGGAACCCAGACCTACATCTGCAACGTGAACCA<br>CAAGCCCAGCAACACCAAGGTGGACGAGAAGGTGGAACCCAAG<br>AGCTGCGACGGCGGAGGCGGATCTGGCGGCGGAGGATCCGAAG<br>TGCAGCTGGTGGAAAGTGGGGGAGGCCTGGTGCAGCCAGGGGG<br>AAGCCTGAGACTGTCTTGTGCCGCTTCCGGCTACTCTTTTACC<br>GGGTATTATATCCATTGGGTGCGGCAGGCTCCAGGGAAAGGCC<br>TGGAATGGGTGGCACGCGTGATCCCTAACGCAGGCGGCACCTC<br>TTATAATCAGAAGTTTAAAGGGCGCTTTACCCTGTCCGTGGAC<br>AATTCCAAGAATACTGCTTACCTGCAGATGAATTCCCTGCGCG<br>CCGAAGATACAGCTGTGTATTACTGCGCCAGAGAAGGGATCTA<br>TTGGTGGGGACAGGGCACCCTCGTGACAGTGTCATCCGCTAGC<br>ACCAAGGGACCTTCCGTGTTTCCCCTGGCTCCCAGCTCCAAGT<br>CTACCTCTGGGGGCACAGCTGCTCTGGGATGTCTGGTGGAAGA<br>TTATTTTCCTGAACCTGTGACCGTGTCATGGAACAGCGGAGCC<br>CTGACCTCCGGGGTGCACACATTCCCTGCTGTGCTGCAGTCCT<br>CCGGCCTGTATAGCCTGAGCAGCGTCGTGACCGTGCCTTCCAG<br>CTCTCTGGGCACACAGACATATATCTGTAATGTGAATCACAAA<br>CCCTCTAATACCAAAGTGGATGAGAAAGTGGAACCTAAGTCCT<br>GCGACAAGACCCACACCTGTCCCCCTTGTCCTGCCCCTGAAGC<br>TGCTGGCGGCCCATCTGTGTTTCTGTTCCCCCCAAAGCCCAAG<br>GACACCCTGATGATCAGCCGGACCCCCGAAGTGACCTGCGTGG<br>TGGTGGATGTGTCCCACGAGGACCCAGAAGTGAAGTTCAATTG<br>GTACGTGGACGGCGTGGAAGTGCACAACGCCAAGACCAAGCCG<br>CGGGAAGAACAGTACAACAGCACCTACCGGGTGGTGTCCGTGC<br>TGACAGTGCTGCACCAGGACTGGCTGAACGGCAAAGAGTACAA<br>GTGCAAGGTGTCCAACAAGGCCCTGGGAGCCCCCATCGAGAAA<br>ACCATCAGCAAGGCCAAGGGCCAGCCCCGCGAACCTCAGGTGT<br>ACACCCTGCCCCCAAGCAGGGACGAGCTGACCAAGAACCAGGT<br>GTCCCTGACCTGTCTCGTGAAGGGCTTCTACCCCTCCGATATC<br>GCCGTGGAATGGGAGAGCAACGGCCAGCCCGAGAACAACTACA<br>AGACCACCCCCCCTGTGCTGGACAGCGACGGCTCATTCTTCCT<br>GTACTCCAAGCTGACCGTGGACAAGAGCCGGTGGCAGCAGGGC<br>AACGTGTTCAGCTGCAGCGTGATGCACGAGGCCCTGCACAACC<br>ACTACACACAGAAGTCTCTGAGCCTGAGCCCTGGCGGAGGGGG<br>AGGATCTGGGGGAGGCGGAAGTGGGGGAGGGGGTTCCGGAGGC<br>GGAGGATCCGAAATCGTGTTAACGCAGTCTCCAGGCACCCTGT<br>CTTTGTCTCCAGGGGAAAGAGCCACCCTCTCTTGCAGGGCCAG<br>TCAGAGTGTTAGCAGCAGCTACTTAGCCTGGTACCAGCAGAAA<br>CCTGGCCAGGCTCCCAGGCTCCTCATCTATGGAGCATCCAGCA<br>GGGCCACTGGCATCCCAGACAGGTTCAGTGGCAGTGGATCCGG<br>GACAGACTTCACTCTCACCATCAGCAGACTGGAGCCTGAAGAT<br>TTTGCAGTGTATTACTGTCAGCAGTATGGTAGCTCACCGCTGA<br>CGTTCGGCCAGGGGACCAAAGTGGAAATCAAAAGCAGCGCTTC<br>CACCAAGGGCCCCTCAGTGTTCCCACTGGCACCATCCAGCAAG<br>TCCACAAGCGGAGGAACCGCCGCTCTGGGCTGTCTCGTGAAAG<br>ACTACTTTCCAGAGCCAGTGACCGTGTCCTGGAATAGTGGCGC<br>TCTGACTTCTGGCGTGCACACTTTCCCCGCAGTGCTGCAGAGT<br>TCTGGCCTGTACTCCCTGAGTAGCGTCGTGACAGTGCCCTCCT<br>CTAGCCTGGGCACTCAGACTTACATCTGCAATGTGAATCATAA<br>GCCTTCCAACACAAAAGTGGACAAAAAAGTGGAACCCAAATCT<br>TGC | |
| +CD40 LC; ,RK' pETR15391 | see above | 110 |
| +DP47VHCL pETR15119 | GAGGTGCAATTGTTGGAGTCTGGGGGAGGCTTGGTACAGCCTG<br>GGGGGTCCCTGAGACTCTCCTGTGCAGCCTCCGGATTCACCTT<br>TAGCAGTTATGCCATGAGCTGGGTCCGCCAGGCTCCAGGGAAG<br>GGGCTGGAGTGGGTCTCAGCTATTAGTGGTAGTGGTGGTAGCA<br>CATACTACGCAGACTCCGTGAAGGGCCGGTTCACCATCTCCAG<br>AGACAATTCCAAGAACACGCTGTATCTGCAGATGAACAGCCTG<br>AGAGCCGAGGACACGGCCGTATATTACTGTGCGAAAGGCAGCG<br>GATTTGACTACTGGGGCCAAGGAACCCTGGTCACCGTCTCGAG<br>TGCTAGCGTGGCCGCTCCCTCCGTGTTCATCTTCCCACCTTCC<br>GACGAGCAGCTGAAGTCCGGCACCGCTTCTGTCGTGTGCCTGC<br>TGAACAACTTCTACCCCCGCGAGGCCAAGGTGCAGTGGAAGGT<br>GGACAACGCCCTGCAGTCCGGCAACAGCCAGGAATCCGTGACC<br>GAGCAGGACTCCAAGGACAGCACCTACTCCCTGTCCTCCACCC<br>TGACCCTGTCCAAGGCCGACTACGAGAAGCACAAGGTGTACGC<br>CTGCGAAGTGACCCACCAGGGCCTGTCTAGCCCCGTGACCAAG<br>TCTTTCAACCGGGGCGAGTGC | 118 |

TABLE 4-continued

Nucleotide sequences of the bispecific antigen binding molecules

| Construct | Sequence | Seq ID No |
|---|---|---|
| mu CD40-28H1 (4 + 1) | | |
| CD40 VHCH1-CD40 VHCH1-FcKK_DAPG-28H1_VH pETR15732 | GAAGTGCAGCTGGTGGAAAGCGACGGCGGACTGGTGCAGCCTG GCAGATCTCTGAAGCTGCCTTGTGCCGCCAGCGGCTTCACCTT CAGCGACTACTACATGGCCTGGGTGCGACAGGCCCCTACCAAG GGACTGGAATGGGTGGCCAGCATCAGCTACGACGGCAGCAGCA CCTACTACAGAGACAGCGTGAAGGGCAGATTCACCATCAGCAG AGACAACGCCAAGAGCACCCTGTACCTGCAGATGGACAGCCTG AGAAGCGAGGACACCGCTACCTACTACTGCGGCAGACACAGCA GCTACTTCGACTACTGGGGCCAGGGCGTGATGGTCACCGTGTC TAGCGCCAAGACCACACCCCCAGCGTGTACCCTCTGGCTCCT GGATCTGCCGCCCAGACCAACAGCATGGTCACACTGGGCTGCC TGGTGAAGGGCTACTTCCCCGAGCCTGTGACCGTGACCTGGAA CAGCGGCTCTCTGTCTAGCGGCGTGCACACCTTCCCTGCCGTG CTGCAGAGCGACCTGTACACCCTGTCCTCCAGCGTGACCGTGC CTTCCTCCACCTGGCCTTCCCAGACCGTGACATGCAACGTGGC CCACCCTGCCAGCTCCACCAAGGTGGACAAGAAAATCGTGCCC CGGGACTGCGGAGGGGCGGTTCCGGCGGAGGAGGATCCGAGG TGCAGCTGGTGGAATCTGATGGGGGCCTGGTGCAGCCCGGAAG AAGCCTGAAACTGCCCTGTGCTGCCTCTGGCTTCACATTCTCT GATTACTATATGGCTTGGGTGCGCCAGGCTCCAACAAAAGGCC TGGAATGGGTGGCATCCATCTCTTACGACGGCTCCTCCACTTA CTACAGGGACTCTGTGAAGGGCCGGTTCACAATCTCCCGGGAT AACGCCAAGTCTACACTGTACCTGCAGATGGATTCCCTGCGCT CCGAGGACACAGCCACATATTACTGTGGCAGGCACTCCTCCTA CTTTGATTATTGGGGACAGGGCGTGATGGTCACAGTGTCCAGC GCTAAGACCACCCCCCCTAGCGTGTACCCTCTGGCCCCTGGAT CTGCCGCCCAGACCAACAGCATGGTGACCCTGGGCTGCCTGGT GAAGGGCTACTTCCCCGAGCCTGTGACCGTGACCTGGAACAGC GGCAGCCTGAGCAGCGGCGTGCACACCTTTCCAGCCGTGCTGC AGAGCGACCTGTACACCCTGAGCAGCTCCGTGACCGTGCCTAG CAGCACCTGGCCCAGCCAGACAGTGACCTGCAACGTGGCCCAC CCTGCCAGCAGCACCAAGGTGGACAAGAAAATCGTGCCCCGGG ACTGCGGCTGCAAGCCCTGCATCTGCACCGTGCCCGAGGTGTC CAGCGTGTTCATCTTCCCACCCAAGCCCAAGGACGTGCTGACC ATCACCCTGACCCCAAAGTGACCTGCGTGGTGGTGGCCATCA GCAAGGACGACCCCGAGGTGCAGTTCTCTTGGTTTGTGGACGA CGTGGAGGTGCACACAGCCCAGACAAAGCCCCGGGAGGAACAG ATCAACAGCACCTTCAGAAGCGTGTCCGAGCTGCCCATCATGC ACCAGGACTGGCTGAACGGCAAAGAATTCAAGTGCAGAGTGAA CAGCGCCGCCTTCGGCGCCCCCATCGAGAAAACCATCAGCAAG ACCAAGGGCAGACCCAAGGCCCCCCAGGTGTACACCATCCCCC CACCCAAAAAACAGATGGCCAAGGACAAGGTGTCCCTGACCTG CATGATCACCAACTTTTTCCCCGAGGACATCACCGTGGAGTGG CAGTGGAATGGCCAGCCCGCCGAGAACTACAAGAACACCCAGC CCATCATGAAGACCGACGGCAGCTACTTCGTGTACAGCAAGCT GAACGTGCAGAAGTCCAACTGGGAGGCCGGCAACACCTTCACC TGTAGCGTGCTGCACGAGGGCCTGCACAACCACCACACCGAGA AGTCCCTGAGCCACTCCCCCGGCGGCGGAGGCGGTTCCGGAGG AGGAGGATCCGGAGGAGGGGGAAGTGGCGGCGGAGGATCTGAG GTGCAGCTGCTGGAATCCGGCGGAGGCCTGGTGCAGCCTGGCG GATCTCTGAGACTGTCCTGCGCCGCCTCCGGCTTCACCTTCTC CTCCCACGCCATGTCCTGGGTCCGACAGGCTCCTGGCAAGGGC CTGGAATGGGTGTCCGCCATCTGGGCCTCCGGCGAGCAGTACT ACGCCGACTCTGTGAAGGGCCGGTTCACCATCTCCCGGGACAA CTCCAAGAACACCCTGTACCTGCAGATGAACTCCCTGCGGGCC GAGGACACCGCCGTGTACTACTGTGCCAAGGGCTGGCTGGGCA ACTTCGACTACTGGGGCCAGGGCACCCTGGTCACCGTGTCCAG C | 119 |
| CD40 VHCH1-CD40 VHCH1-FcDD_DAPG-28H1_VL pETR15731 | GAAGTGCAGCTGGTGGAAAGCGACGGCGGACTGGTGCAGCCTG GCAGATCTCTGAAGCTGCCTTGTGCCGCCAGCGGCTTCACCTT CAGCGACTACTACATGGCCTGGGTGCGACAGGCCCCTACCAAG GGACTGGAATGGGTGGCCAGCATCAGCTACGACGGCAGCAGCA CCTACTACAGAGACAGCGTGAAGGGCAGATTCACCATCAGCAG AGACAACGCCAAGAGCACCCTGTACCTGCAGATGGACAGCCTG AGAAGCGAGGACACCGCTACCTACTACTGCGGCAGACACAGCA GCTACTTCGACTACTGGGGCCAGGGCGTGATGGTCACCGTGTC TAGCGCCAAGACCACACCCCCCAGCGTGTACCCTCTGGCTCCT GGATCTGCCGCCCAGACCAACAGCATGGTCACACTGGGCTGCC TGGTGAAGGGCTACTTCCCCGAGCCTGTGACCGTGACCTGGAA CAGCGGCTCTCTGTCTAGCGGCGTGCACACCTTCCCTGCCGTG CTGCAGAGCGACCTGTACACCCTGTCCTCCAGCGTGACCGTGC | 120 |

TABLE 4-continued

Nucleotide sequences of the bispecific antigen binding molecules

| Construct | Sequence | Seq ID No |
|---|---|---|
| | CTTCCTCCACCTGGCCTTCCCAGACCGTGACATGCAACGTGGC<br>CCACCCTGCCAGCTCCACCAAGGTGGACAAGAAAATCGTGCCC<br>CGGGACTGCGGAGGGGCGGTTCCGGCGGAGGAGGATCCGAGG<br>TGCAGCTGGTGGAATCTGATGGGGGCCTGGTGCAGCCCGGAAG<br>AAGCCTGAAACTGCCCTGTGCTGCCTCTGGCTTCACATTCTCT<br>GATTACTATATGGCTTGGGTGCGCCAGGCTCCAACAAAAGGCC<br>TGGAATGGGTGGCATCCATCTCTTACGACGGCTCCTCCACTTA<br>CTACAGGGACTCTGTGAAGGGCCGGTTCACAATCTCCCGGGAT<br>AACGCCAAGTCTACACTGTACCTGCAGATGGATTCCCTGCGCT<br>CCGAGGACACAGCCACATATTACTGTGGCAGGCACTCCTCCTA<br>CTTTGATTATTGGGGACAGGGCGTGATGGTCACAGTGTCCAGC<br>GCTAAGACCACCCCCCCTAGCGTGTACCCTCTGGCCCCTGGAT<br>CTGCCGCCCAGACCAACAGCATGGTGACCCTGGGCTGCCTGGT<br>GAAGGGCTACTTCCCCGAGCCTGTGACCGTGACCTGGAACAGC<br>GGCAGCCTGAGCAGCGGCGTGCACACCTTTCCAGCCGTGCTGC<br>AGAGCGACCTGTACACCCTGAGCAGCTCCGTGACCGTGCCTAG<br>CAGCACCTGGCCCAGCCAGACAGTGACCTGCAACGTGGCCCAC<br>CCTGCCAGCAGCACCAAGGTGGACAAGAAAATCGTGCCCCGGG<br>ACTGCGGCTGCAAGCCCTGCATCTGCACCGTGCCCGAGGTGTC<br>CAGCGTGTTCATCTTCCCACCCAAGCCCAAGGACGTGCTGACC<br>ATCACCCTGACCCCCAAAGTGACCTGCGTGGTGGTGGCCATCA<br>GCAAGGACGACCCCGAGGTGCAGTTCTCTTGGTTTGTGGACGA<br>CGTGGAGGTGCACACAGCCCAGACAAAGCCCGGGAGGAACAG<br>ATCAACAGCACCTTCAGAAGCGTGTCCGAGCTGCCCATCATGC<br>ACCAGGACTGGCTGAACGGCAAAGAATTCAAGTGCAGAGTGAA<br>CAGCGCCGCCTTCGGCGCCCCCATCGAGAAAACCATCAGCAAG<br>ACCAAGGGCAGACCCAAGGCCCCCAGGTGTACACCATCCCCC<br>CACCCAAAGAACAGATGGCCAAGGACAAGGTGTCCCTGACCTG<br>CATGATCACCAACTTTTTCCCCGAGGACATCACCGTGGAGTGG<br>CAGTGGAATGGCCAGCCCGCCGAGAACTACGACAACACCCAGC<br>CCATCATGGACACCGACGGCAGCTACTTCGTGTACAGCGACCT<br>GAACGTGCAGAAGTCCAACTGGGAGGCCGGCAACACCTTCACC<br>TGTAGCGTGCTGCACGAGGGCCTGCACAACCACCACACCGAGA<br>AGTCCCTGAGCCACAGCCCAGGCGGCGGAGGCGGATCTGGCGG<br>AGGAGGTTCCGGAGGTGGCGGATCTGGGGCGGTGGATCTGAG<br>ATCGTGCTGACCCAGTCTCCCGGCACCCTGAGCCTGAGCCCTG<br>GCGAGAGAGCCACCCTGAGCTGCAGAGCCAGCCAGAGCGTGAG<br>CCGGAGCTACCTGGCCTGGTATCAGCAGAAGCCCGGCCAGGCC<br>CCCAGACTGCTGATCATCGGCGCCAGCACCCGGGCCACCGGCA<br>TCCCCGATAGATTCAGCGGCAGCGGCTCCGGCACCGACTTCAC<br>CCTGACCATCAGCCGGCTGGAACCCGAGGACTTCGCCGTGTAC<br>TACTGCCAGCAGGGCCAGGTGATCCCCCCCACCTTCGGCCAGG<br>GCACCAAGGTGGAAATCAAG | |
| mu CD40 light chain pETR13185 | GACACTGTACTGACCCAGTCTCCTGCTTTGGCTGTGTCTCCAG<br>GAGAGAGGGTTACCATCTCCTGTAGGGCCAGTGACAGTGTCAG<br>TACACTTATGCACTGGTACCAACAGAAACCAGGACAGCAACCC<br>AAACTCCTCATCTATCTAGCATCACACCTAGAATCTGGGGTCC<br>CTGCCAGGTTCAGTGGCAGTGGGTCTGGGACAGACTTCACCCT<br>CACCATTGATCCTGTGGAGGCTGATGACACTGCAACCTATTAC<br>TGTCAGCAGAGTTGGAATGATCCGTGGACGTTCGGTGGAGGCA<br>CCAAGCTGGAATTGAAACGTGCCGATGCTGCACCAACTGTATC<br>GATTTTCCCACCATCCAGTGAGCAGTTAACATCTGGAGGTGCC<br>TCAGTCGTGTGCTTCTTGAACAACTTCTACCCCAAAGACATCA<br>ATGTCAAGTGGAAGATTGATGGCAGTGAACGACAAAATGGCGT<br>CCTGAACAGTTGGACTGATCAGGACAGCAAAGACAGCACCTAC<br>AGCATGAGCAGCACCCTCACGTTGACCAAGGACGAGTATGAAC<br>GACATAACAGCTATACCTGTGAGGCCACTCACAAGACATCAAC<br>TTCACCCATTGTCAAGAGCTTCAACAGGAATGAGTGT | 121 |
| mu CD40-28H1 (4 + 2) | | |
| CD40 VHCH1-CD40 VHCH1- Fc_DAPG- 28H1 VLCH1 pETR15744 | GAAGTGCAGCTGGTGGAATCCGACGGCGGACTGGTGCAGCCTG<br>GCAGATCTCTGAAGCTGCCTTGTGCCGCCTCCGGCTTCACCTT<br>CTCCGACTACTACATGGCCTGGGTGCGACAGGCCCCCTACCAAG<br>GGACTGGAATGGGTGGCCTCCATCTCCTACGACGGCTCCTCCA<br>CCTACTACCGGGACTCTGTGAAGGGCCGGTTCACCATCTCTCG<br>GGACAACGCCAAGTCCACCCTGTACCTGCAGATGGCATCCCTG<br>CGGAGCGAGGACACCGCTACCTACTACTGCGGCAGACACTCCT<br>CCTACTTCGACTACTGGGGCCAGGGCGTGATGGTCACCGTGTC<br>CTCTGCTAAGACCACCCCCCCCTCCGTGTACCCTCTGGCTCCT<br>GGATCTGCCGCCCAGACCAACTCCATGGTCACCCTGGGCTGTC<br>TGGTGGAAGGCTACTTCCCCGAGCCTGTGACCGTGACCTGGAA | 122 |

TABLE 4-continued

Nucleotide sequences of the bispecific antigen binding molecules

| Construct | Sequence | Seq ID No |
|---|---|---|
| | CTCCGGCTCTCTGTCCTCTGGCGTGCACACCTTCCCTGCCGTG<br>CTGCAGTCCGACCTGTACACCCTGAGCAGCTCCGTGACCGTG<br>CTAGCAGCACCTGGCCCAGCCAGACAGTGACCTGCAACGTGGC<br>CCACCCTGCCAGCAGCACCAAGGTGGACGAGAAAATCGTGCCC<br>CGGGACTGCGGCGGTGGAGGTTCCGGAGGCGGCGGATCCGAGG<br>TGCAGCTGGTGGAAAGTGATGGGGGCCTGGTGCAGCCCGGAAG<br>AAGCCTGAAACTGCCCTGCGCCGCTTCTGGCTTTACCTTTAGC<br>GATTACTATATGGCTTGGGTGCGCCAGGCTCCAACAAAAGGCC<br>TGGAATGGGTGGCATCTATCAGCTACGATGGCAGCAGCACCTA<br>CTATAGAGACAGCGTGAAGGGGAGATTCACCATCAGCAGAGAT<br>AACGCTAAGAGCACACTGTACCTGCAGATGGATAGCCTGAGAT<br>CCGAGGATACCGCCACATATTACTGTGGCCGGCACAGCAGCTA<br>CTTTGATTATTGGGGACAGGGCGTGATGGTCACAGTGTCTAGC<br>GCTAAGACTACCCCTCCTAGCGTGTACCCCCTGGCACCAGGTT<br>CCGCTGCTCAGACCAACAGCATGGTCACACTGGGATGCCTGGT<br>GGAAGGATATTTTCCTGAACCCGTGACAGTGACATGGAATAGC<br>GGCTCCCTGTCTAGCGGAGTGCATACCTTTCCAGCTGTGCTGC<br>AGAGCGATCTGTATACACTGAGCAGCTCTGTGACAGTGCCTTC<br>CAGCACCTGGCCCAGCCAGACAGTGACCTGTAATGTGGCTCAT<br>CCCGCCTCTAGCACCAAAGTGGATGAGAAATCGTGCCCCGGG<br>ACTGCGGCTGCAAGCCCTGTATCTGTACCGTGCCCGAGGTGTC<br>CTCCGTGTTCATCTTCCCACCTAAGCCCAAGGACGTGCTGACA<br>ATCACCCTGACCCCCAAAGTGACCTGCGTGGTGGTGGCCATCT<br>CCAAGGACGATCCCGAGGTGCAGTTCAGTTGGTTCGTGGACGA<br>CGTGGAAGTGCACACAGCCCAGACAAAGCCCAGAGAGGAACAG<br>ATCAACTCCACCTTCAGAAGCGTGTCCGAGCTGCCCATCATGC<br>ACCAGGACTGGCTGAACGGCAAAGAATTCAAGTGCAGAGTGAA<br>CTCCGCCGCCTTTGGCGCCCCTATCGAAAAGACCATCTCCAAG<br>ACCAAGGGCAGACCCAAGGCCCCCCAGGTGTACACAATCCCCC<br>CACCCAAAGAACAGATGGCCAAGGACAAGGTGTCCCTGACCTG<br>CATGATCACCAACTTTTTCCCAGAGGACATCACCGTGGAATGG<br>CAGTGGAACGGCCAGCCCGCCGAGAACTACAAGAACACCCAGC<br>CCATCATGGACACCGACGGCTCCTACTTCGTGTACTCCAAGCT<br>GAACGTGCAGAAGTCCAACTGGGAGGCCGGCAACACCTTCACC<br>TGTTCCGTGCTGCACGAGGGCCTGCACAACCACCACACCGAGA<br>AGTCCCTGTCCCACTCCCCTGGAAAAGGCGGAGGCGGATCTGG<br>TGGCGGAGGATCTGGCGGTGGTGGTTCCGGAGGCGGTGGATCT<br>GAGATCGTGCTGACCCAGTCTCCCGGCACCCTGTCACTGTCTC<br>CAGGCGAGAGAGCCACCCTGTCCTGCAGAGCCTCTCAGTCCGT<br>GTCCCGGTCTTACCTGGCCTGGTATCAGCAGAAGCCCGGCCAG<br>GCTCCCCGGCTGCTGATCATCGGAGCTTCTACCAGAGCCACCG<br>GCATCCCCGACAGATTCTCCGGCTCTGGCTCTGGCACCGACTT<br>CACCCTGACCATCTCTCGGCTGGAACCCGAGGACTTCGCCGTG<br>TACTACTGCCAGCAGGGCCAAGTGATCCCCCCCACCTTTGGCC<br>AGGGCACCAAGGTGGAAATCAAGTCCAGCGCTAAGACCACCCC<br>CCCCTCCGTGTATCCTCTGGCCCCTGGATCTGCCGCCCAGACC<br>AACTCCATGGTCACCCTGGGCTGCCTCGTGAAGGGCTACTTCC<br>CTGAGCCTGTGACCGTGACCTGGAACTCCGGCTCCCTGTCTAG<br>CGGCGTGCACACCTTTCCAGCTGTGCTGCAGTCCGACCTGTAC<br>ACCCTGAGCAGCTCCGTGACCGTGCCTTCCTCCACCTGGCCTT<br>CCCAGACCGTGACATGCAACGTGGCCCACCCTGCCAGCTCCAC<br>AAAGGTGGACAAGAAAATCGTGCCCCGGGACTGC | |
| 28H1 VHCL<br>(mu)<br>pETR15650 | GAAGTGCAGCTGCTGGAATCCGGCGGAGGCCTGGTGCAGCCTG<br>GCGGATCTCTGAGACTGTCCTGCGCCGCCTCCGGCTTCACCTT<br>CTCCTCCCACGCCATGTCCTGGGTCCGACAGGCTCCTGGCAAA<br>GGCCTGGAATGGGTGTCCGCCATCTGGGCCTCCGGCGAGCAGT<br>ACTACGCCGACTCTGTGAAGGGCCGGTTCACCATCTCCCGGGA<br>CAACTCCAAGAACACCCTGTACCTGCAGATGAACTCCCTGCGG<br>GCCGAGGACACCGCCGTGTACTACTGTGCCAAGGGCTGGCTGG<br>GCAACTTCGACTACTGGGGACAGGGCACCCTGGTCACCGTGTC<br>CAGCGCTTCTGATGCCGCCCCTACCGTATCGATTTTCCCACCC<br>TCCAGCGAGCAGCTGACAAGCGGCGGAGCTAGCGTCGTGTGCT<br>TCCTGAACAACTTCTACCCCAAGGACATCAACGTGAAGTGGAA<br>GATCGACGGCAGCGAGCGGCAGAACGGCGTGCTGAATAGCTGG<br>ACCGACCAGGACAGCAAGGACTCCACCTACAGCATGAGCAGCA<br>CCCTGACCCTGACCAAGGACGAGTACGAGCGGCACAACAGCTA<br>CACATGCGAGGCCACCCACAAGACCAGCACCAGCCCCATCGTG<br>AAGTCCTTCAACCGGAACGAGTGC | 123 |
| mu CD40 light<br>chain; 'RK'<br>pETR15649 | GACACTGTACTGACCCAGTCTCCTGCTTTGGCTGTGTCTCCAG<br>GAGAGAGGGTTACCATCTCCTGTAGGGCCAGTGACAGTGTCAG<br>TACACTTATGCACTGGTACCAACAGAAACCAGGACAGCAACCC<br>AAACTCCTCATCTATCTAGCATCACACCTAGAATCTGGGGTCC | 124 |

TABLE 4-continued

Nucleotide sequences of the bispecific antigen binding molecules

| Construct | Sequence | Seq ID No |
|---|---|---|
| | CTGCCAGGTTCAGTGGCAGTGGGTCTGGGACAGACTTCACCCT<br>CACCATTGATCCTGTGGAGGCTGATGACACTGCAACCTATTAC<br>TGTCAGCAGAGTTGGAATGATCCGTGGACGTTCGGTGGAGGCA<br>CCAAGCTGGAATTGAAACGTGCCGATGCTGCACCAACTGTATC<br>GATTTTCCCACCATCCAGTCGGAAGTTAACATCTGGAGGTGCC<br>TCAGTCGTGTGCTTCTTGAACAACTTCTACCCCAAAGACATCA<br>ATGTCAAGTGGAAGATTGATGGCAGTGAACGACAAAATGGCGT<br>CCTGAACAGTTGGACTGATCAGGACAGCAAAGACAGCACCTAC<br>AGCATGAGCAGCACCCTCACGTTGACCAAGGACGAGTATGAAC<br>GACATAACAGCTATACCTGTGAGGCCACTCACAAGACATCAAC<br>TTCACCCATTGTCAAGAGCTTCAACAGGAATGAGTGT | | mu CD40-DP47 (4 + 1)

| Construct | Sequence | Seq ID No |
|---|---|---|
| CD40<br>VHCH1-CD40<br>VHCH1-<br>FcKK_DAPG-<br>DP47 VH<br>pETR15734 | GAAGTGCAGCTGGTGGAAAGCGACGGCGGACTGGTGCAGCCTG<br>GCAGATCTCTGAAGCTGCCTTGTGCCGCCAGCGGCTTCACCTT<br>CAGCGACTACTACATGGCCTGGGTGCGACAGGCCCCTACCAAG<br>GGACTGGAATGGGTGGCCAGCATCAGCTACGACGGCAGCAGCA<br>CCTACTACAGAGACAGCGTGAAGGGCAGATTCACCATCAGCAG<br>AGACAACGCCAAGAGCACCCTGTACCTGCAGATGGACAGCCTG<br>AGAAGCGAGGACACCGCTACCTACTACTGCGCGGCAGACACAGCA<br>GCTACTTCGACTACGGGGCCAGGGCGTGATGGTCACCGTGTC<br>TAGCGCCAAGACCACACCCCCAGCGTGTACCCTCTGGCTCCT<br>GGATCTGCCGCCCAGACCAACAGCATGGTCACACTGGGCTGCC<br>TGGTGAAGGGCTACTTCCCCGAGCCTGTGACCGTGACCTGGAA<br>CAGCGGCTCTCTGTCTAGCGGCGTGCACACCTTCCCTGCCGTG<br>CTGCAGAGCGACCTGTACACCCTGTCCTCCAGCGTGACCGTGC<br>CTTCCTCCACCTGGCCTTCCCAGACCGTGACATGCAACGTGGC<br>CCACCCTGCCAGCTCCACCAAGGTGGACAAGAAAATCGTGCCC<br>CGGGACTGCGGAGGGGCGGTTCCGGCGGAGGAGGATCCGAGG<br>TGCAGCTGGTGGAATCTGATGGGGGCCTGGTGCAGCCCGGAAG<br>AAGCCTGAAACTGCCCTGTGCTGCCTCTGGCTTCACATTCTCT<br>GATTACTATATGGCTTGGGTGCGCCAGGCTCCAACAAAAGGCC<br>TGGAATGGGTGGCATCCATCTCTTACGACGGCTCCTCCACTTA<br>CTACAGGGACTCTGTGAAGGGCCGGTTCACAATCTCCCGGGAT<br>AACGCCAAGTCTACACTGTACCTGCAGATGGATTCCCTGCGCT<br>CCGAGGACACAGCCACATATTACTGTGGCAGGCACTCCTCCTA<br>CTTTGATTATTGGGGACAGGGCGTGATGGTCACAGTGTCCAGC<br>GCTAAGACCACCCCCCCTAGCGTGTACCCTCTGGCCCCTGGAT<br>CTGCCGCCCAGACCAACAGCATGGTGACCCTGGGCTGCCTGGT<br>GAAGGGCTACTTCCCCGAGCCTGTGACCGTGACCTGGAACAGC<br>GGCAGCCTGAGCAGCGGCGTGCACACCTTTCCAGCCGTGCTGC<br>AGAGCGACCTGTACACCCTGAGCAGCTCCGTGACCGTGCCTAG<br>CAGCACCTGGCCCAGCCAGACAGTGACCTGCAACGTGGCCCAC<br>CCTGCCAGCAGCACCAAGGTGGACAAGAAAATCGTGCCCCGGG<br>ACTGCGGCTGCAAGCCCTGCATCTGCACCGTGCCCGAGGTGTC<br>CAGCGTGTTCATCTTCCCACCCAAGCCCAAGGACGTGCTGACC<br>ATCACCCTGACCCCCAAAGTGACCTGCGTGGTGGTGGCCATCA<br>GCAAGGACGACCCCGAGGTGCAGTTCTCTTGGTTTGTGGACGA<br>CGTGGAGGTGCACACAGCCCAGACAAAGCCCCGGGAGGAACAG<br>ATCAACAGCACCTTCAGAAGCGTGTCCGAGCTGCCCATCATGC<br>ACCAGGACTGGCTGAACGGCAAAGAATTCAAGTGCAGAGTGAA<br>CAGCGCCGCCTTCGGCGCCCCCATCGAGAAAACCATCAGCAAG<br>ACCAAGGGCAGACCCAAGGCCCCCCAGGTGTACACCATCCCCC<br>CACCCAAAAAACAGATGGCCAAGGACAAGGTGTCCCTGACCTG<br>CATGATCACCAACTTTTTCCCCGAGGACATCACCGTGGAGTGG<br>CAGTGGAATGGCCAGCCCGCCGAGAACTACAAGAACACCCAGC<br>CCATCATGAAGACCGACGGCAGCTACTTCGTGTACAGCAAGCT<br>GAACGTGCAGAAGTCCAACTGGGAGGCCGGCAACACCTTCACC<br>TGTAGCGTGCTGCACGAGGGCCTGCACAACCACCACACCGAGA<br>AGTCCCTGAGCCACTCCCCCGGCGGCGGAGGCGGTTCCGGAGG<br>AGGAGGATCCGGAGGAGGGGGAAGTGGCGGCGGAGGATCTGAG<br>GTGCAATTGTTGGAGTCTGGGGGAGGCTTGGTACAGCCTGGGG<br>GGTCCCTGAGACTCTCCTGTGCAGCCAGCGGATTCACCTTTAG<br>CAGTTATGCCATGAGCTGGGTCCGCCAGGCTCCAGGGAAGGGG<br>CTGGAGTGGGTCTCAGCTATTAGTGGTAGTGGTGGTAGCACAT<br>ACTACGCAGACTCCGTGAAGGGCCGGTTCACCATCTCCAGAGA<br>CAATTCCAAGAACACGCTGTATCTGCAGATGAACAGCCTGAGA<br>GCCGAGGACACGGCCGTATATTACTGTGCGAAAGGCAGCGGAT<br>TTGACTACTGGGGCCAAGGAACCCTGGTCACCGTCTCGAGC | 125 |

TABLE 4-continued

Nucleotide sequences of the bispecific antigen binding molecules

| Construct | Sequence | Seq ID No |
|---|---|---|
| CD40 VHCH1-CD40 VHCH1-FcDD DAPG-DP47 VL pETR15733 | GAAGTGCAGCTGGTGGAAAGCGACGGCGGACTGGTGCAGCCTG GCAGATCTCTGAAGCTGCCTTGTGCCGCCAGCGGCTTCACCTT CAGCGACTACTACATGGCCTGGGTGCGACAGGCCCCCTACCAAG GGACTGGAATGGGTGGCCAGCATCAGCTACGACGGCAGCAGCA CCTACTACAGAGACAGCGTGAAGGGCAGATTCACCATCAGCAG AGACAACGCCAAGAGCACCCTGTACCTGCAGATGGACAGCCTG AGAAGCGAGGACACCGCTACCTACTACTGCGGCAGACACAGCA GCTACTTCGACTACTGGGGCCAGGGCGTGATGGTCACCGTGTC TAGCGCCAAGACCACACCCCCCAGCGTGTACCCTCTGGCTCCT GGATCTGCCGCCCAGACCAACAGCATGGTCACACTGGGCTGCC TGGTGAAGGGCTACTTCCCCGAGCCTGTGACCGTGACCTGGAA CAGCGGCTCTCTGTCTAGCGGCGTGCACACCTTCCCTGCCGTG CTGCAGAGCGACCTGTACACCCTGTCCTCCAGCGTGACCGTGC CTTCCTCCACCTGGCCTTCCCAGACCGTGACATGCAACGTGGC CCACCCTGCCAGCTCCACCAAGGTGGACAAGAAAATCGTGCCC CGGGACTGCGGAGGGGCGGTTCCGGCGGAGGAGGATCCGAGG TGCAGCTGGTGGAATCTGATGGGGGCCTGGTGCAGCCCGGAAG AAGCCTGAAACTGCCCTGTGCTGCCTCTGGCTTCACATTCTCT GATTACTATATGGCTTGGGTGCGCCAGGCTCCAACAAAAGGCC TGGAATGGGTGGCATCCATCTCTTACGACGGCTCCTCCACTTA CTACAGGGACTCTGTGAAGGGCCGGTTCACAATCTCCCGGGAT AACGCCAAGTCTACACTGTACCTGCAGATGGATTCCCTGCGCT CCGAGGACACAGCCACATATTACTGTGGCAGGCACTCCTCCTA CTTTGATTATTGGGGACAGGGCGTGATGGTCACAGTGTCCAGC GCTAAGACCACCCCCCCAGCGTGTACCCTCTGGCCCCTGGAT CTGCCGCCCAGACCAACAGCATGGTGACCCTGGGCTGCCTGGT GAAGGGCTACTTCCCCGAGCCTGTGACCGTGACCTGGAACAGC GGCAGCCTGAGCAGCGGCGTGCACACCTTTCCAGCCGTGCTGC AGAGCGACCTGTACACCCTGAGCAGCTCCGTGACCGTGCCTAG CAGCACCTGGCCCAGCCAGACAGTGACCTGCAACGTGGCCCAC CCTGCCAGCAGCACCAAGGTGGACAAGAAAATCGTGCCCCGGG ACTGCGGCTGCAAGCCCTGCATCTGCACCGTGCCCGAGGTGTC CAGCGTGTTCATCTTCCCACCCAAGCCCAAGGACGTGCTGACC ATCACCCTGACCCCCAAAGTGACCTGCGTGGTGGTGGCCATCA GCAAGGACGACCCCGAGGTGCAGTTCTCTTGGTTTGTGGACGA CGTGGAGGTGCACACAGCCCAGACAAAGCCCCGGGAGGAACAG ATCAACAGCACCTTCAGAAGCGTGTCCGAGCTGCCCATCATGC ACCAGGACTGGCTGAACGGCAAAGAATTCAAGTGCAGAGTGAA CAGCGCCGCCTTCGGCGCCCCCATCGAGAAAACCATCAGCAAG ACCAAGGGCAGACCCAAGGCCCCCCAGGTGTACACCATCCCCC CACCCAAAGAACAGATGGCCAAGGACAAGGTGTCCCTGACCTG CATGATCACCAACTTTTTCCCCGAGGACATCACCGTGGAGTGG CAGTGGAATGGCCAGCCCGCCGAGAACTACGACAACACCCAGC CCATCATGGACACCGACGGCAGCTACTTCGTGTACAGCGACCT GAACGTGCAGAAGTCCAACTGGGAGGCCGGCAACACCTTCACC TGTAGCGTGCTGCACGAGGGCCTGCACAACCACCACACCGAGA AGTCCCTGAGCCACAGCCCAGGCGGCGGAGGCGGATCTGGCGG AGGAGGTTCCGGAGGCGGCGGAAGCGGAGGGGGAGGCTCTGAA ATTGTGCTGACCCAGAGCCCCGGCACCCTGTCACTGTCTCCAG GCGAAAGAGCCACCCTGAGCTGCAGAGCCAGCCAGAGCGTGTC CAGCTCTTACCTGGCCTGGTATCAGCAGAAGCCCGGACAGGCC CCCAGACTGCTGATCTACGGCGCCTCTTCTAGAGCCACCGGCA TCCCCGATAGATTCAGCGGCAGCGGCTCCGGCACCGACTTCAC CCTGACAATCAGCAGACTGGAACCCGAGGACTTTGCCGTGTAT TACTGCCAGCAGTACGGCAGCAGCCCCCTGACCTTTGGCCAGG GCACCAAGGTGGAAATCAAA | 126 |
| +mu CD40 light chain | see above | 121 | mu CD40 × DP47 (4 + 2)

| CD40 VHCH1-CD40 VHCH1-Fc_DAPG-28H1 VLCH1 'EE' pETR15748 | GAAGTGCAGCTGGTGGAATCCGACGGCGGACTGGTGCAGCCTG GCAGATCTCTGAAGCTGCCTTGTGCCTCCCGGCTTCACCTT CTCCGACTACTACATGGCCTGGGTGCGACAGGCCCCCTACCAAG GGACTGGAATGGGTGGCCTCCATCTCCTACGACGGCTCCTCCA CCTACTACCGGGACTCTGTGAAGGGCCGGTTCACCATCTCTCG GGACAACGCCAAGTCCACCCTGTACCTGCAGATGGACTCCCTG CGGAGCGAGGACACCGCTACCTACTACTGCGGCAGACACTCCT CCTACTTCGACTACTGGGGCCAGGGCGTGATGGTCACCGTGTC CTCTGCTAAGACCACCCCCCCCTCCGTGTACCCTCTGGCTCCT GGATCTGCCGCCCAGACCAACTCCATGGTCACCCTGGGCTGTC TGGTGGAAGGCTACTTCCCCGAGCCTGTGACCGTGACCTGGAA | 127 |

TABLE 4-continued

Nucleotide sequences of the bispecific antigen binding molecules

| Construct | Sequence | Seq ID No |
|---|---|---|
| | CTCCGGCTCTCTGTCCTCTGGCGTGCACACCTTCCCTGCCGTG<br>CTGCAGTCCGACCTGTACACCCTGAGCAGCTCCGTGACCGTGC<br>CTAGCAGCACCTGGCCCAGCCAGACAGTGACCTGCAACGTGGC<br>CCACCCTGCCAGCAGCACCAAGGTGGACGAGAAAATCGTGCCC<br>CGGGACTGCGGCGGTGGAGGTTCCGGAGGCGGCGGATCCGAGG<br>TGCAGCTGGTGGAAAGTGATGGGGGCCTGGTGCAGCCCGGAAG<br>AAGCCTGAAACTGCCCTGCGCCGCTTCTGGCTTTACCTTTAGC<br>GATTACTATATGGCTTGGGTGCGCCAGGCTCCAACAAAAGGCC<br>TGGAATGGGTGGCATCTATCAGCTACGATGGCAGCAGCACCTA<br>CTATAGAGACAGCGTGAAGGGGAGATTCACCATCAGCAGAGAT<br>AACGCTAAGAGCACACTGTACCTGCAGATGGATAGCCTGAGAT<br>CCGAGGATACCGCCACATATTACTGTGGCCGGCACAGCAGCTA<br>CTTTGATTATTGGGGACAGGGCGTGATGGTCACAGTGTCTAGC<br>GCTAAGACTACCCCTCCTAGCGTGTACCCCCTGGCACCAGGTT<br>CCGCTGCTCAGACCAACAGCATGGTCACACTGGGATGCCTGGT<br>GGAAGGATATTTTCCTGAACCCGTGACAGTGACATGGAATAGC<br>GGCTCCCTGTCTAGCGGAGTGCATACCTTTCCAGCTGTGCTGC<br>AGAGCGATCTGTATACACTGAGCAGCTCTGTGACAGTGCCTTC<br>CAGCACCTGGCCCAGCCAGACAGTGACCTGTAATGTGGCTCAT<br>CCCGCCTCTAGCACCAAAGTGGATGAGAAATCGTGCCCCGGG<br>ACTGCGGCTGCAAGCCCTGTATCTGTACCGTGCCCGAGGTGTC<br>CTCCGTGTTCATCTTCCCACCTAAGCCCAAGGACGTGCTGACA<br>ATCACCCTGACCCCCAAAGTGACCTGCGTGGTGGTGGCCATCT<br>CCAAGGACGATCCCGAGGTGCAGTTCAGTTGGTTCGTGGACGA<br>CGTGGAAGTGCACACAGCCCAGACAAAGCCCAGAGAGGAACAG<br>ATCAACTCCACCTTCAGAAGCGTGTCCGAGCTGCCCATCATGC<br>ACCAGGACTGGCTGAACGGCAAAGAATTCAAGTGCAGAGTGAA<br>CTCCGCCGCCTTTGGCGCCCCTATCGAAAAGACCATCTCCAAG<br>ACCAAGGGCAGACCCAAGGCCCCCCAGGTGTACACAATCCCCC<br>CACCCAAAGAACAGATGGCCAAGGACAAGGTGTCCCTGACCTG<br>CATGATCACCAACTTTTTCCCAGAGGACATCACCGTGGAATGG<br>CAGTGGAACGGCCAGCCCGCCGAGAACTACAAGAACACCCAGC<br>CCATCATGGACACCGACGGCTCCTACTTCGTGTACTCCAAGCT<br>GAACGTGCAGAAGTCCAACTGGGAGGCCGGCAACACCTTCACC<br>TGTTCCGTGCTGCACGAGGGCCTGCACAACCACCACACCGAGA<br>AGTCCCTGTCCCACTCCCCTGGAAAAGGCGGAGGCGGATCTGG<br>TGGCGGAGGATCTGGCGGTGGTGGTTCCGGAGGCGGAGGATCC<br>GAAATCGTGTTAACGCAGTCTCCAGGCACCCTGTCTTTGTCTC<br>CAGGGGAAAGAGCCACCCTCTCTTGCAGGGCCAGTCAGAGTGT<br>TAGCAGCAGCTACTTAGCCTGGTACCAGCAGAAACCTGGCCAG<br>GCTCCCAGGCTCCTCATCTATGGAGCATCCAGCAGGGCCACTG<br>GCATCCCAGACAGGTTCAGTGGCAGTGGATCCGGGACAGACTT<br>CACTCTCACCATCAGCAGACTGGAGCCTGAAGATTTTGCAGTG<br>TATTACTGTCAGCAGTATGGTAGCTCACCGCTGACGTTCGGCC<br>AGGGGACCAAAGTGGAAATCAAAAGCAGCGCTAAGACCACCCC<br>CCCCTCCGTGTATCCTCTGGCCCCTGGATCTGCCGCCCAGACC<br>AACTCCATGGTCACCCTGGGCTGCCTCGTGAAGGGCTACTTCC<br>CTGAGCCTGTGACCGTGACCTGGAACTCCGGCTCCCTGTCTAG<br>CGGCGTGCACACCTTTCCAGCTGTGCTGCAGTCCGACCTGTAC<br>ACCCTGAGCAGCTCCGTGACCGTGCCTTCCTCCACCTGGCCTT<br>CCCAGACCGTGACATGCAACGTGGCCCACCCTGCCAGCTCCAC<br>AAAGGTGGACAAGAAAATCGTGCCCCGGGACTGC | |
| +mu CD40 light chain; ,RK' | see above | 124 |
| DP47 VHCL (mu) pETR15652 | GAGGTGCAATTGTTGGAGTCTGGGGGAGGCTTGGTACAGCCTG<br>GGGGGTCCCTGAGACTCTCCTGTGCAGCCTCCGGATTCACCTT<br>TAGCAGTTATGCCATGAGCTGGGTCCGCCAGGCTCCAGGGAAG<br>GGGCTGGAGTGGGTCTCAGCTATTAGTGGTAGTGGTGGTAGCA<br>CATACTACGCAGATCCGTGAAGGGCCGGTTCACCATCTCCAG<br>AGACAATTCCAAGAACACGCTGTATCTGCAGATGAACAGCCTG<br>AGAGCCGAGGACACGGCCGTATATTACTGTGCGAAAGGCAGCG<br>GATTTGACTACTGGGGCCAAGGAACCCTGGTCACCGTCTCGAG<br>CGCTTCTGATGCCGCCCCTACCGTATCGATTTTCCCACCCTCC<br>AGCGAGCAGCTGACAAGCGGCGGAGCTAGCGTCGTGTGCTTCC<br>TGAACAACTTCTACCCCAAGGACATCAACGTGAAGTGGAAGAT<br>CGACGGCAGCGAGCGGCAGAACGGCGTGCTGAATAGCTGGAC<br>GACCAGGACAGCAAGGACTCCACCTACAGCATGAGCAGCACCC<br>TGACCCTGACCAAGGACGAGTACGAGCGGCACAACAGCTACAC<br>ATGCGAGGCCACCCACAAGACCAGCACCAGCCCCATCGTGAAG<br>TCCTTCAACCGGAACGAGTGC | 128 |

1.2 Production of Bispecific Antigen Binding Molecules Targeting CD40 and Fibroblast Activation Protein (FAP)

The molecules were produced by co-transfecting either HEK293-EBNA cells growing in suspension with the mammalian expression vectors using polyethylenimine (PEI) or co-transfecting CHO K1 cells growing in suspension with the mammalian expression using eviFECT. The cells were transfected with the corresponding expression vectors.

For production in HEK293 EBNA cells HEK293 EBNA cells were cultivated in suspension serum free in EX-CELL R: culture medium containing 6 mM L-glutamine and 250 mg/L G418. For the production in 600 mL tubespin flasks (max, working volume 400 mL) 600 million HEK293 EBNA cells were seeded 24 hours before transfection. For transfection 800 million cells were centrifuged for 5 min at 210×g and supernatant was replaced by 20 mL pre-warmed CD CHO medium. Expression vectors were mixed in 20 mL CD CHO medium to a final amount of 400 µg DNA. After addition of 1080 µL PEI solution (2.7 µg/mL) the mixture was vortexed for 15 s and subsequently incubated for 10 min at room temperature. Afterwards cells were mixed with the DNA/PEI solution, transferred to a 600 mL tubespin flask and incubated for 3 hours at 37° C., in an incubator with a 5% $CO_2$ atmosphere. After incubation, 360) mL EX-CELL® medium, containing 6 mM L-glutamine. 5 g/L Pepsoy and 1.25 mM VPA, was added and cells were cultivated for 24 hours. One day after transfection 12% Feed 7 and 3 g/l Glucose were added. After 7 days the cultivation supernatant was collected for purification by centrifugation for 60 min at 2500×g (Sigma 8K centrifuge). The solution was sterile filtered 20) (0.22 µm filter) and sodium azide was added to a final concentration of 0.01% w/v and kept at 4° C.

For production in HEK293 EBNA cells HEK293 EBNA in suspension-adapted CHO K1 cells (adapted to serum-free growth in suspension culture) the cells were grown in eviGrow medium (evitria AG. Switzerland), a chemically defined, animal-component free, serum-free medium and transfected with eviFect (evitria AG. Switzerland). After transfection the cells were kept in eviMake (evitria AG. Switzerland), a chemically defined, animal-component free, serum-free medium, at 37° C., and 5% $CO_2$ for 7 days.

After 7 days the cultivation supernatant was collected for purification by centrifugation for 45 min at maximum speed in a Rotanta 460 RC. The solution was sterile filtered (0.22 µm filter) and kept at 4° C. The concentration of the molecules in the culture medium was either determined by Protein A-HPLC or Protein A-Bio-Layer Interferometry (BLI).

The secreted protein was purified from cell culture supernatants by affinity chromatography using Protein A affinity chromatography, followed by a size exclusion chromatographic step. For affinity chromatography supernatant was loaded on a HiTrap MabSelect SuRe column (Column Volume (CV)=5 mL, GE Healthcare) equilibrated with 25 ml 20 mM sodium phosphate, 20 mM sodium citrate, pH 7.5. Unbound protein was removed by washing with at least 10 CV 20 mM sodium phosphate, 20 mM sodium citrate, pH 7.5 and target protein was eluted in 6 CV 20 mM sodium citrate, 100 mM sodium chloride, 100 mM glycine, pH 3.0. Protein solution was neutralized by adding ⅒ of 0.5 M sodium phosphate, pH 8.0. The target protein was concentrated and filtrated prior loading on a HiLoad XK16/60 SUPERDEX® 200 column (GE Healthcare) equilibrated with 20 mM histidine, 140 mM sodium chloride, pH 6.0, 0.01% Tween20. The protein concentration of purified protein sample was determined by measuring the optical density (OD) at 280 nm, using the molar extinction coefficient calculated on the basis of the amino acid sequence.

Purity and molecular weight of the molecule after the final purification step were analyzed by CE-SDS analyses in the presence and absence of a reducing agent. The Caliper LABCHIP® GXII system (Caliper Lifescience) was used according to the manufacturer's instruction.

The aggregate content of the molecule was analyzed using a TSKGEL® G3000 SW XL analytical size-exclusion column (Tosoh) in 25 mM potassium phosphate, 125 mM sodium chloride, 200 mM L-arginine monohydrochloride, 0.02% (w/v) $NaN_3$, pH 6.7 running buffer at 25° C.

TABLE 5

Production yield and quality of bispecific CD40 antigen binding molecules

| Construct | Yield [mg/L] | Concentration [mg/ml] | Monomer [%] | HMW [%] | LMW [%] |
|---|---|---|---|---|---|
| huCD40-28H1; 4 + 1 | 48.2 | 8.9 | 97.8 | 1.2 | 1.0 |
| huCD40-28H1; 4 + 2 | 48.1 | 9.2 | 99.7 | 0.3 | — |
| huCD40-28H1; 2 + 1 | 10.1 | 2.0 | 99.5 | 0.5 | — |
| huCD40-28H1; 2 + 2 | 26.7 | 2.0 | 100.0 | — | — |
| huCD40-DP47; 4 + 1 | 15.5 | 2.3 | 98.7 | 1.3 | — |
| huCD40-DP47; 4 + 2 | 33.8 | 3.6 | 96.8 | 3.2 | — |
| huCD40 IgG | 190.3 | 11.8 | 99.8 | 0.2 | — |
| muCD40-28H1; 4 + 1 | 3.4 | 0.5 | 92.4 | 7.6 | — |
| muCD40-28H1; 4 + 2 | 3.9 | 1.6 | 98.9 | 0.4 | 0.7 |
| muCD40 IgG | 19.8 | 5.0 | 97.8 | — | 2.2 |
| muCD40-DP47; 4 + 1 | 2.2 | 0.3 | 90.6 | 9.4 | — |
| muCD40-DP47; 4 + 2 | 1.5 | 0.6 | 86.5 | 7.8 | 5.7 |

1.3 Generation of Further Bispecific Antigen Binding Molecules Targeting CD40 and Fibroblast Activation Protein (FAP)

In analogy to Example 1.1, different types of constructs of bispecific CD40-FAP antibodies have been prepared. For example, a bispecific antibody consisting of one CD40 binding moiety combined with one FAP binding moiety was prepared (FIG. 15A). Because the CrossMAb technology as described in WO 2010/145792 A1 was used to ensure correct light chain pairing, the format is called 1+1 CrossMAb. Another 2+1 format called "head-to-tail" was prepared wherein a CD40 binding Fab is fused to the N-terminus of a FAP binding Fab (FIG. 15B) and a further 2+1 format consisting of two CD40 binding moieties combined with either one FAP binding crossFab at the C-terminus of an Fc (FIG. 1E) was produced. Furthermore, a 4+1 format consisting of four CD40 binding moieties combined with one FAP binding crossFab at the C-terminus of an Fc (FIG. 15C) was prepared. In all these constructs, the variable heavy and light chain domains of the anti CD40 binder correspond to the CD40 binder as described in WO 2006/128103 (SEQ ID NO: 10 and SEQ ID NO: 16 of said document). The generation and preparation of FAP binder 28H1 is described in WO 2012/020006 A2, which is incorporated herein by reference. To generate the 1+1, 2+1 and 4+1 molecules the knob-into-hole technology was used to achieve heterodimerization. The S354C/T366W mutations have been introduced in the first heavy chain HC1 (Fc knob heavy chain) and the γ349C/T366S/L368A/γ407V mutations are introduced in the second heavy chain HC2 (Fc hole heavy chain). Furthermore, the CrossMAb technology as described in WO 2010/145792 A1 ensures correct light chain pairing. Independent of the bispecific format, in all cases an effector silent Fc (P329G: L234, 234A) has been used to abrogate binding to Fcγ receptors according to the method described in WO 2012/130831 A1. Amino acid Sequences of the bispecific molecules are shown in Table 6.

All genes are transiently expressed under control of a chimeric MPSV promoter consisting of the MPSV core promoter combined with the CMV promoter enhancer fragment. The expression vector also contains the oriP region for episomal replication in EBNA (Epstein Barr Virus Nuclear Antigen) containing host cells.

TABLE 6

Amino acid sequences of the bispecific antigen binding molecules

| Construct | Sequence | Seq ID No |
|---|---|---|
| P1AE0192 CD40 × FAP (28H1) (1 + 1) Crossmab | | |
| 28H1 light chain cross VHCL | EVQLLESGGGLVQPGGSLRLSCAASGFTFSSHAMSWVRQAPGK GLEWVSAIWASGEQYYADSVKGRFTISRDNSKNTLYLQMNSLR AEDTAVYYCAKGWLGNFDYWGQGTLVTVSSASVAAPSVFIFPP SDEQLKSGTASVVCLLNNFYPREAKVQWKVDNALQSGNSQESV TEQDSKDSTYSLSSTLTLSKADYEKHKVYACEVTHQGLSSPVT KSFNRGEC | 162 |
| 28H1 (VLCH1)_FC knob_PGLALA | EIVLTQSPGTLSLSPGERATLSCRASQSVSRSYLAWYQQKPGQ APRLLIIGASTRATGIPDRFSGSGSGTDFILTISRLEPEDFAV YYCQQGQVIPPTFGQGTKVEIKSSASTKGPSVFPLAPSSKSTS GGTAALGCLVKDYFPEPVTVSWNSGALTSGVHTFPAVLQSSGL YSLSSVVTVPSSSLGTQTYICNVNHKPSNTKVDKKVEPKSCDK THTCPPCPAPEAAGGPSVFLFPPKPKDILMISRTPEVTCVVVD VSHEDPEVKFNWYVDGVEVHNAKTKPREEQYNSTYRVVSVLTV LHQDWLNGKEYKCKVSNKALGAPIEKTISKAKGQPREPQVYTL PPCRDELTKNQVSLWCLVKGFYPSDIAVEWESNGQPENNYKTT PPVLDSDGSFFLYSKLTVDKSRWQQGNVFSCSVMHEALHNHYT QKSLSLSPG | 163 |
| CD40 (VHCH1 charged)_Fc hole_PGLALA | EVQLVESGGGLVQPGGSLRLSCAASGYSFTGYYIHWVRQAPGK GLEWVARVIPNAGGTSYNQKFKGRFTLSVDNSKNTAYLQMNSL RAEDTAVYYCAREGIYWWGQGTLVTVSSASTKGPSVFPLAPSS KSTSGGTAALGCLVEDYFPEPVTVSWNSGALTSGVHTFPAVLQ SSGLYSLSSVVTVPSSSLGTQTYICNVNHKPSNTKVDEKVEPK SCDKTHICPPCPAPEAAGGPSVFLFPPKPKDTLMISRTPEVTC VVVDVSHEDPEVKFNWYVDGVEVHNAKTKPREEQYNSTYRVVS VLTVLHQDWLNGKEYKCKVSNKALGAPIEKTISKAKGQPREPQ VCTLPPSRDELTKNQVSLSCAVKGFYPSDIAVEWESNGQPENN YKTTPPVLDSDGSFFLVSKLTVDKSRWQQGNVFSCSVMHEALH NRFTQKSLSLSPG | 164 |
| CD40 light chain (charged) | DIQMTQSPSSLSASVGDRVTITCRSSQSLVHSNGNTFLHWYQQ KPGKAPKLLIYTVSNRFSGVPSRFSGSGSGTDFTLTISSLQPE DFATYFCSQTTHVPWTFGQGTKVEIKRTVAAPSVFIFPPSDRK LKSGTASVVCLLNNFYPREAKVQWKVDNALQSGNSQESVTEQD SKDSTYSLSSTLTLSKADYEKHKVYACEVTHQGLSSPVTKSFN RGEC | 165 |
| P1AE0408 CD40 × FAP (28H1) (2 + 1) head to tail | | |
| 28H1 light chain cross VHCL | EVQLLESGGGLVQPGGSLRLSCAASGFTFSSHAMSWVRQAPGK GLEWVSAIWASGEQYYADSVKGRFTISRDNSKNTLYLQMNSLR AEDTAVYYCAKGWLGNFDYWGQGTLVTVSSASVAAPSVFIFPP SDEQLKSGTASVVCLLNNFYPREAKVQWKVDNALQSGNSQESV TEQDSKDSTYSLSSTLTLSKADYEKHKVYACEVTHQGLSSPVT KSFNRGEC | 162 |
| CD40 light chain (charged) | DIQMTQSPSSLSASVGDRVTITCRSSQSLVHSNGNTFLHWYQQ KPGKAPKLLIYTVSNRFSGVPSRFSGSGSGTDFTLTISSLQPE DFATYFCSQTTHVPWTFGQGTKVEIKRTVAAPSVFIFPPSDRK LKSGTASVVCLLNNFYPREAKVQWKVDNALQSGNSQESVTEQD SKDSTYSLSSTLTLSKADYEKHKVYACEVTHQGLSSPVTKSFN RGEC | 165 |
| CD40 (VHCH1 charged) 28H1 (VLCH1)_FC knob_PGLALA | EVQLVESGGGLVQPGGSLRLSCAASGYSFTGYYIHWVRQAPGK GLEWVARVIPNAGGTSYNQKFKGRFTLSVDNSKNTAYLQMNSL RAEDTAVYYCAREGIYWWGQGTLVTVSSASTKGPSVFPLAPSS KSTSGGTAALGCLVEDYFPEPVTVSWNSGALTSGVHTFPAVLQ SSGLYSLSSVVTVPSSSLGTQTYICNVNHKPSNTKVDEKVEPK SCDGGGGSGGGGSEIVLTQSPGTLSLSPGERATLSCRASQSVS RSYLAWYQQKPGQAPRLLIIGASTRATGIPDRFSGSGSGTDFT LTISRLEPEDFAVYYCQQGQVIPPTFGQGTKVEIKSSASTKGP SVFPLAPSSKSTSGGTAALGCLVKDYFPEPVTVSWNSGALTSG VHTFPAVLQSSGLYSLSSVVTVPSSSLGTQTYICNVNHKPSNT KVDKKVEPKSCDKTHTCPPCPAPEAAGGPSVFLFPPKPKDTLM ISRIPEVTCVVVDVSHEDPEVKFNWYVDGVEVHNAKTKPREEQ YNSTYRVVSVLTVLHQDWLNGKEYKCKVSNKALGAPIEKTISK | 166 |

TABLE 6-continued

Amino acid sequences of the bispecific antigen binding molecules

| Construct | Sequence | Seq ID No |
|---|---|---|
| | AKGQPREPQVYTLPPCRDELTKNQVSLWCLVKGFYPSDIAVEW ESNGQPENNYKTTPPVLDSDGSFFLYSKLTVDKSRWQQGNVFS CSVMHEALHNHYTQKSLSLSPG | |
| CD40 (VHCH1 charged)_Fc hole_PGLALA | EVQLVESGGGLVQPGGSLRLSCAASGYSFTGYYIHWVRQAPGK GLEWVARVIPNAGGTSYNQKFKGRFTLSVDNSKNTAYLQMNSL RAEDTAVYYCAREGIYWWGQGTLVTVSSASTKGPSVFPLAPSS KSTSGGTAALGCLVEDYFPEPVTVSWNSGALTSGVHTFPAVLQ SSGLYSLSSVVTVPSSSLGTQTYICNVNHKPSNTKVDEKVEPK SCDKTHTCPPCPAPEAAGGPSVFLFPPKPKDTLMISRTPEVIC VVVDVSHEDPEVKFNWYVDGVEVHNAKTKPREEQYNSTYRVVS VLTVLHQDWLNGKEYKCKVSNKALGAPIEKTISKAKGQPREPQ VCTLPPSRDELTKNQVSLSCAVKGFYPSDIAVEWESNGQPENN YKTTPPVLDSDGSFFLVSKLTVDKSRWQQGNVFSCSVMHEALH NRFTQKSLSLSPGK | 164 |

CD40 x FAP (28H1) (2 + 1) C-terminal crossFab fusion

| Construct | Sequence | Seq ID No |
|---|---|---|
| 28H1 light chain cross VHCL | EVQLLESGGGLVQPGGSLRLSCAASGFTFSSHAMSWVRQAPGK GLEWVSAIWASGEQYYADSVKGRFTISRDNSKNTLYLQMNSLR AEDTAVYYCAKGWLGNFDYWGQGTLVTVSSASVAAPSVFIFPP SDEQLKSGTASVVCLLNNFYPREAKVQWKVDNALQSGNSQESV TEQDSKDSTYSLSSTLTLSKADYEKHKVYACEVTHQGLSSPVT KSFNRGEC | 162 |
| CD40 light chain (charged) | DIQMTQSPSSLSASVGDRVTITCRSSQSLVHSNGNTFLHWYQQ KPGKAPKLLIYTVSNRFSGVPSRFSGSGSGTDFTLTISSLQPE DFATYFCSQTTHVPWTFGQGTKVEIKRTVAAPSVFIFPPSDRK LKSGTASVVCLLNNFYPREAKVQWKVDNALQSGNSQESVTEQD SKDSTYSLSSTLTLSKADYEKHKVYACEVTHQGLSSPVTKSFN RGEC | 165 |
| CD40 (VHCH1 charged)_Fc knob_PGLALA_ 28H1 (VLCH1) | EVQLVESGGGLVQPGGSLRLSCAASGYSFTGYYIHWVRQAPGK GLEWVARVIPNAGGTSYNQKFKGRFTLSVDNSKNTAYLQMNSL RAEDTAVYYCAREGIYWWGQGTLVTVSSASTKGPSVFPLAPSS KSTSGGTAALGCLVEDYFPEPVTVSWNSGALTSGVHTFPAVLQ SSGLYSLSSVVTVPSSSLGTQTYICNVNHKPSNTKVDEKVEPK SCDKTHTCPPCPAPEAAGGPSVFLFPPKPKDTLMISRTPEVIC VVVDVSHEDPEVKFNWYVDGVEVHNAKTKPREEQYNSTYRVVS VLTVLHQDWLNGKEYKCKVSNKALGAPIEKTISKAKGQPREPQ VYTLPPCRDELTKNQVSLWCLVKGFYPSDIAVEWESNGQPENN YKTTPPVLDSDGSFFLYSKLTVDKSRWQQGNVFSCSVMHEALH NHYTQKSLSLSPGGGGSGGGGSGGGGSGGGGSEIVLTQSPGT LSLSPGERATLSCRASQSVSRSYLAWYQQKPGQAPRLLIIGAS TRATGIPDRFSGSGSGTDFTLTISRLEPEDFAVYYCQQGQVIP PTFGQGTKVEIKSSASTKGPSVFPLAPSSKSTSGGTAALGCLV KDYFPEPVTVSWNSGALTSGVHTFPAVLQSSGLYSLSSVVTVP SSSLGTQTYICNVNHKPSNTKVDKKVEPKSC | 167 |
| CD40 (VHCH1 charged)_Fc hole_PGLALA | EVQLVESGGGLVQPGGSLRLSCAASGYSFTGYYIHWVRQAPGK GLEWVARVIPNAGGTSYNQKFKGRFTLSVDNSKNTAYLQMNSL RAEDTAVYYCAREGIYWWGQGTLVTVSSASTKGPSVFPLAPSS KSTSGGTAALGCLVEDYFPEPVTVSWNSGALTSGVHTFPAVLQ SSGLYSLSSVVTVPSSSLGTQTYICNVNHKPSNTKVDEKVEPK SCDKTHTCPPCPAPEAAGGPSVFLFPPKPKDTLMISRTPEVTC VVVDVSHEDPEVKFNWYVDGVEVHNAKTKPREEQYNSTYRVVS VLTVLHQDWLNGKEYKCKVSNKALGAPIEKTISKAKGQPREPQ VCTLPPSRDELTKNQVSLSCAVKGFYPSDIAVEWESNGQPENN YKTTPPVLDSDGSFFLVSKLTVDKSRWQQGNVFSCSVMHEALH NHYTQKSLSLSPG | 168 |

P1AE0637 CD40 x FAP (28H1) (4 + 1) C-terminal crossFab fusion

| Construct | Sequence | Seq ID No |
|---|---|---|
| 28H1 light chain cross VHCL | EVQLLESGGGLVQPGGSLRLSCAASGFTFSSHAMSWVRQAPGK GLEWVSAIWASGEQYYADSVKGRFTISRDNSKNTLYLQMNSLR AEDTAVYYCAKGWLGNFDYWGQGTLVTVSSASVAAPSVFIFPP SDEQLKSGTASVVCLLNNFYPREAKVQWKVDNALQSGNSQESV TEQDSKDSTYSLSSTLTLSKADYEKHKVYACEVTHQGLSSPVT KSFNRGEC | 162 |

TABLE 6-continued

Amino acid sequences of the bispecific antigen binding molecules

| Construct | Sequence | Seq ID No |
|---|---|---|
| CD40 light chain (charged) | DIQMTQSPSSLSASVGDRVTITCRSSQSLVHSNGNTFLHWYQQ KPGKAPKLLIYTVSNRFSGVPSRFSGSGSGTDFTLTISSLQPE DFATYFCSQTTHVPWTFGQGTKVEIKRTVAAPSVFIFPPSDRK LKSGTASVVCLLNNFYPREAKVQWKVDNALQSGNSQESVTEQD SKDSTYSLSSTLTLSKADYEKHKVYACEVTHQGLSSPVTKSFN RGEC | 165 |
| CD40 (VHCH1 charged_CD40 (VHCH1 charged)-Fc knob_PGLALA_ 28H1 (VLCH1) | EVQLVESGGGLVQPGGSLRLSCAASGYSFTGYYIHWVRQAPGK GLEWVARVIPNAGGTSYNQKFKGRFTLSVDNSKNTAYLQMNSL RAEDTAVYYCAREGIYWWGQGTLVTVSSASTKGPSVFPLAPSS KSTSGGTAALGCLVEDYFPEPVTVSWNSGALTSGVHTFPAVLQ SSGLYSLSSVVTVPSSSLGTQTYICNVNHKPSNTKVDEKVEPK SCDGGGGSGGGGSEVQLVESGGGLVQPGGSLRLSCAASGYSFT GYYIHWVRQAPGKGLEWVARVIPNAGGTSYNQKFKGRFTLSVD NSKNTAYLQMNSLRAEDTAVYYCAREGIYWWGQGTLVTVSSAS TKGPSVFPLAPSSKSTSGGTAALGCLVEDYFPEPVTVSWNSGA LTSGVHTFPAVLQSSGLYSLSSVVTVPSSSLGTQTYICNVNHK PSNTKVDEKVEPKSCDKTHTCPPCPAPEAAGGPSVFLFPPKPK DTLMISRTPEVTCVVVDVSHEDPEVKFNWYVDGVEVHNAKTKP REEQYNSTYRVVSVLTVLHQDWLNGKEYKCKVSNKALGAPIEK TISKAKGQPREPQVYTLPPCRDELTKNQVSLWCLVKGFYPSDI AVEWESNGQPENNYKTTPPVLDSDGSFFLYSKLTVDKSRWQQG NVFSCSVMHEALHNHYTQKSLSLSPGGGGGSGGGGSGGGGSGG GGSEIVLTQSPGTLSLSPGERATLSCRASQSVSRSYLAWYQQK PGQAPRLLIIGASTRATGIPDRFSGSGSGTDFTLTISRLEPED FAVYYCQQGQVIPPTFGQGTKVEIKSSASTKGPSVFPLAPSSK STSGGTAALGCLVKDYFPEPVTVSWNSGALTSGVHTFPAVLQS SGLYSLSSVVTVPSSSLGTQTYICNVNHKPSNTKVDKKVEPKS C | 169 |
| CD40 (VHCH1 charged_CD40 (VHCH1 charged)-Fc hole_PGLALA | EVQLVESGGGLVQPGGSLRLSCAASGYSFTGYYIHWVRQAPGK GLEWVARVIPNAGGTSYNQKFKGRFTLSVDNSKNTAYLQMNSL RAEDTAVYYCAREGIYWWGQGTLVTVSSASTKGPSVFPLAPSS KSTSGGTAALGCLVEDYFPEPVTVSWNSGALTSGVHTFPAVLQ SSGLYSLSSVVTVPSSSLGTQTYICNVNHKPSNTKVDEKVEPK SCDGGGGSGGGGSEVQLVESGGGLVQPGGSLRLSCAASGYSFT GYYIHWVRQAPGKGLEWVARVIPNAGGTSYNQKFKGRFTLSVD NSKNTAYLQMNSLRAEDTAVYYCAREGIYWWGQGTLVTVSSAS TKGPSVFPLAPSSKSTSGGTAALGCLVEDYFPEPVTVSWNSGA LTSGVHTFPAVLQSSGLYSLSSVVTVPSSSLGTQTYICNVNHK PSNTKVDEKVEPKSCDKTHTCPPCPAPEAAGGPSVFLFPPKPK DTLMISRTPEVTCVVVDVSHEDPEVKFNWYVDGVEVHNAKTKP REEQYNSTYRVVSVLTVLHQDWLNGKEYKCKVSNKALGAPIEK TISKAKGQPREPQVCTLPPSRDELTKNQVSLSCAVKGFYPSDI AVEWESNGQPENNYKTTPPVLDSDGSFFLVSKLTVDKSRWQQG NVFSCSVMHEALHNHYTQKSLSLSPG | 170 |

Expression of the Bispecific Antibodies

Antibodies were expressed by transient transfection of HEK cells grown in suspension with expression vectors encoding the 4 different peptide chains. Transfection into HEK293-F cells (Invitrogen) was performed according to the cell supplier's instructions using Maxiprep (QIAGEN®) preparations of the antibody vectors, F17 medium (Invitrogen, USA), PEIPRO® (Polyscience Europe GmbH) and an initial cell density of 1-2 million viable cells/ml in serum free FREESTYLE™ 293 expression medium (Invitrogen). Cell culture supernatants were harvested after 7 days of cultivation in shake flasks or stirred fermenters by centrifugation at 14000 g for 30 minutes and filtered through a 0.22 µm filter.

Purification of the Bispecific Antibodies

Antibodies were purified from cell culture supernatants by affinity chromatography using MabSelect Sure-SEPHAROSE™ (GE Healthcare, Sweden) chromatography. Briefly, sterile filtered cell culture supernatants were captured on a MabSelect SuRe resin equilibrated with PBS buffer (10 mM Na2HPO$_4$, 1 mM KH$_2$PO$_4$, 137 mM NaCl and 2.7 mM KCl, pH 7.4), washed with equilibration buffer and eluted with 25 mM cirate, pH 3.0. After neutralization with 1 M Tris pH 9.0, aggregated protein was separated from monomeric antibody species by size exclusion chromatography (SUPERDEX® 200, GE Healthcare) in 20 mM histidine, 140 mM NaCl, pH 6.0. Monomeric protein fractions were pooled, concentrated if required using e.g. a MILLIPORE Amicon Ultra (30KD MWCO) centrifugal concentrator and stored at −80° C. Sample aliquots were used for subsequent analytical characterization e.g. by CE-SDS, size exclusion chromatography, mass spectrometry and endotoxin determination.

1.4 Characterization of Bispecific Constructs Targeting CD40 and FAP 1.4.1 Binding to Human or Mouse FAP-Expressing Murine Fibroblast Cells The binding to cell surface FAP was tested using human fibroblast activating protein (huFAP) expressing cells NIH/3T3-huFAP clone 19 or mouse fibroblast activating protein (mFAP) expressing cells NIH/3T3-mFAP clone 26. NIH/3T3-huFAP clone 19 and NIH/3T3-mFAP clone 26 were generated by the transfection of the mouse embryonic fibroblast NIH/3T3 cell line (ATCC CRL-1658) with the expression vector pETR4921 to express under 1.5 µg/mL Puromycin selection huFAP or mFAP, respectively. NIH/3T3 wildtype (wt) cells that were not transfected with FAP and that do not express FAP were used as a negative control.

NIH/3T3-huFAP. NIH/3T3-mFAP or NIH/3T3-wt cells were cultured with 1×Dulbecco's Modified Eagle's Medium (DMEM) (Gibco. Cat. No. 42430-025) supplemented with 10% Fetal Bovine Serum (FBS) (life technologies, Cat. No. 16140, Lot No. 1797306A). For the NIH/3T3-huFAP and NIH/3T3-mFAP cells 1.5 µg/mL Puromycin (Gibco. Cat. No. A11138-03) was added to the medium for selection of FAP-expressing cells. NIH/3T3 cells were removed from the plate by using enzyme-free Cell Dissociation Buffer (Gibco. Cat. No. 13151014). $0.3 \times 10^5$ NIH/3T3-huFAP clone 19. NIH/3T3-mFAP clone 26 or NIH/3T3-wt were added in 200 ul of 1× DMEM 10% FBS to each well of a round-bottom 96-well plate (Greiner Bio-One. CELLSTAR®, Cat. No. 650185). Plates were centrifuged 5 minutes at 1700 rpm and supernatants were flicked off. Cells were washed once with 200 µL of 4° C., cold FACS buffer (eBioscience, Cat. No. 00-4222-26). All samples were resuspended in 50 µL/well of 4° C., cold FACS buffer containing the bispecific antigen binding molecules (primary antibody) or isotype control antibody DP47 at the indicated range of concentrations (in duplicates) and incubated for 120 minutes at 4° C. Afterwards the cells were washed three times with 200 µL 4° C., cold FACS buffer. Cells were further stained with 25 µL/well of 4° C., cold secondary antibody solution (1:50 dilution of secondary antibody) containing R-Phycoerythrin (PE) conjugated AffiniPure F(ab')$_2$ Fragment Goat Anti-Human IgG. Fcγ Fragment Specific (Jackson ImmunoResearch, Cat. No. 109-116-098) and incubated for 60 minutes at 4° C., in the dark. Cells were washed with 200 µl FACS buffer and resuspended in 85 µL/well FACS-buffer containing 0.2 µg/mL DAPI (Roche, Cat. No. 10236276001) and acquired the same day using 5-laser LSR-Fortessa (BD Bioscience with DIVA software). Data analysis was performed using the FlowJo version 10 software (FlowJo LLC).

Figure 2A:
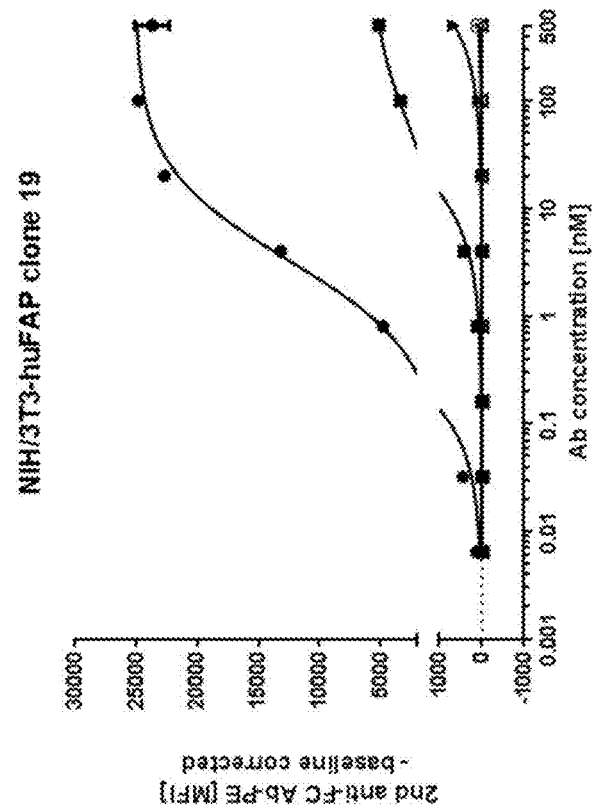
FIG. 2A and FIG. 2B show the binding of human tetravalent anti-CD40) antibodies in a FAP-targeted monovalent or bivalent format to FAP negative tumor cells (FIG. 2A) and FAP positive tumor cells (FIG. 2B). The transgenic modified mouse embryonic fibroblast NIH/3T3-huFAP clone 19 expresses high levels of human fibroblast activation protein (huFAP), whereas the parental cell line NIH/3T3-wt expresses no huFAP. Only the tetravalent anti-CD40) antigen binding molecules with either one or two FAP binding moieties but not the non-FAP targeted formats efficiently bind to NIH/3T3-huFAP cells (FIG. 2B). The bivalent FAP construct binds stronger than the monovalent construct. In contrast, no binding of the FAP-targeted anti-CD40) antibodies to the NIH/3T3-wt cells was detected (FIG. 2A), Shown is the binding as median of fluorescence intensity (MFI) of phycoerythrin (PE)-labeled anti-human IgG Fcγ-specific goat IgG F(ab')2 fragment which is used as secondary detection antibody. MFI was measured by flow cytometry. The x-axis shows the concentration of antibody constructs.
Figure 2B:
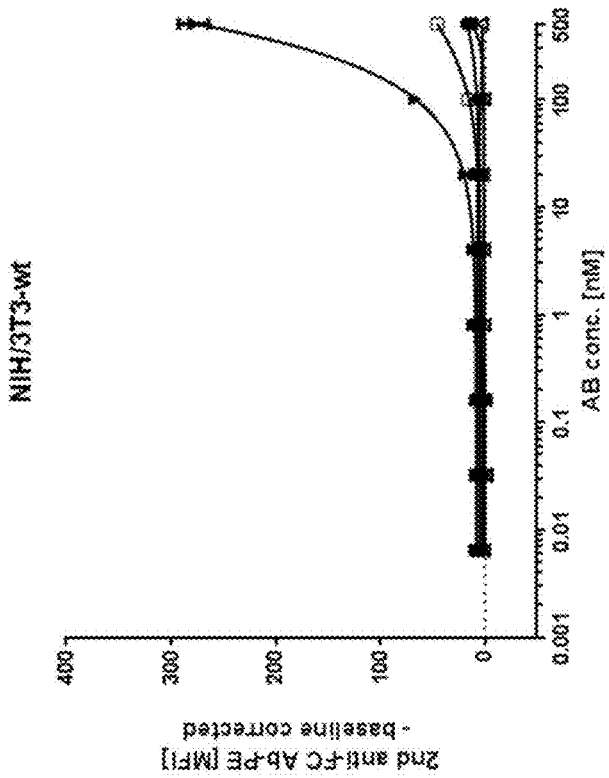
Figure 17:
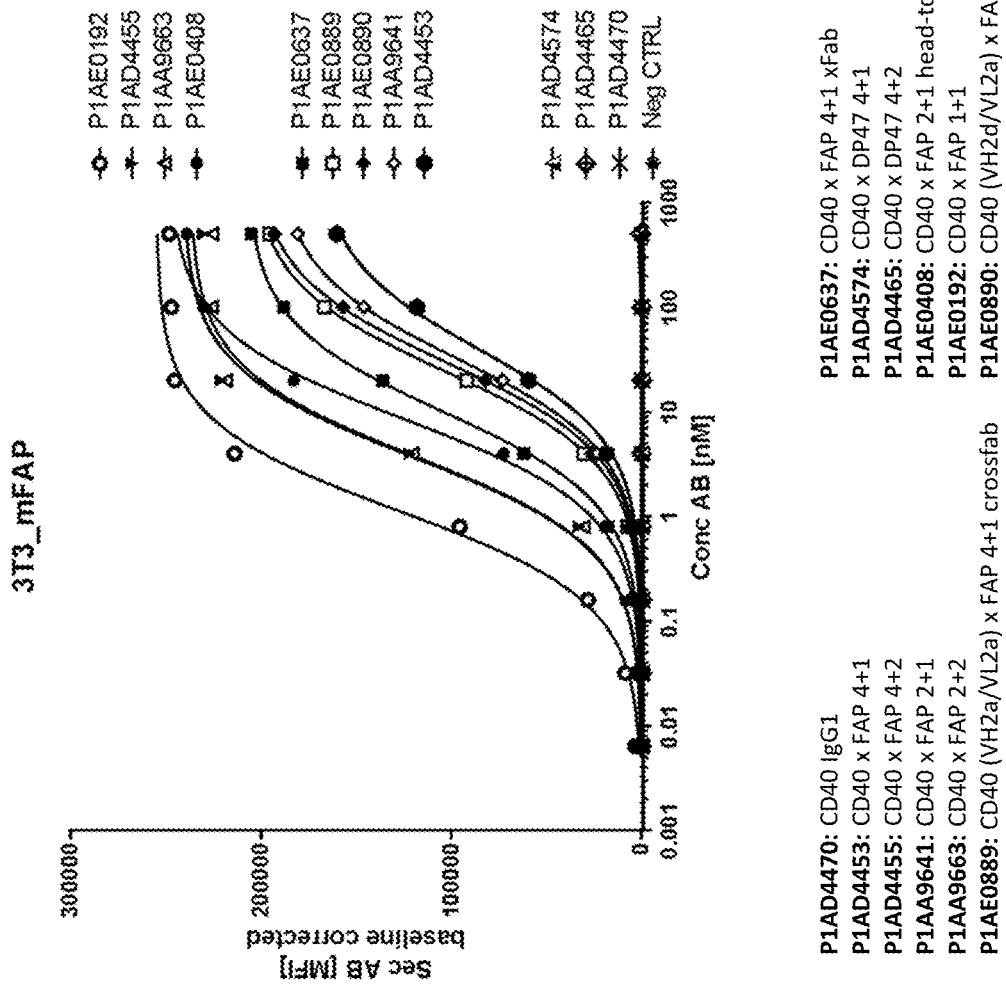
FIG. 17 shows the binding of human tetravalent, bivalent or monovalent anti-CD40) antibodies in a FAP-targeted monovalent or bivalent format to FAP positive tumor cells. The transgenic modified mouse embryonic fibroblast NIH/3T3-mFAP cell line expresses high levels of murine fibroblast activation protein (mFAP). All depicted constructs vary in their binding strength ($EC_{50}$ values as well as signal strength) to NIH/3T3-mFAP cells. Only the anti-CD40) antigen binding molecules with either one or two FAP binding moieties but not the non-FAP-targeted formats (P1AD4574 and P1AD4465) efficiently bind to NIH/3T3-mFAP cells. The bivalent FAP constructs with C-terminal FAP binding domains bind stronger than the monovalent construct with C-terminal FAP binding domains. The strongest FAP binding was observed for the 1+1 format. Shown is the binding as median of fluorescence intensity (MFI) of phycoerythrin (PE)-labeled anti-human IgG Fcγ-specific goat IgG F(ab')2 fragment which is used as secondary detection antibody. MFI was measured by flow cytometry. The x-axis shows the concentration of antibody constructs.

As shown in FIG. 2A, FIG. 2B and FIG. 17, the bispecific antibodies monovalent or bivalent for FAP bind to human and mouse FAP-expressing target cells. Therefore, only FAP-targeted anti-CD40 antigen binding molecules show direct tumor-targeting properties. The bivalent FAP constructs with C-terminal FAP binding domains bind stronger than the monovalent construct with C-terminal FAP binding domain explained by a gain of avidity in the bivalent relative to the monovalent FAP format. The strongest FAP binding was observed for the 1+1 format (P1AE0192). No binding of the FAP-targeted antibodies to the NIH/3T3-wt cells was detected. The EC$_{50}$ values as measured for different bispecific antibodies are shown in Table 7 below.

TABLE 7

Human FAP binding characterization of 28H1 in different bispecific antibody formats

| Molecule | | EC$_{50}$ [nM] |
|---|---|---|
| P1AD4470 | CD40 IgG1 PGLALA | n/a |
| P1AE0637 | CD40 × FAP 4 + 1 with C-terminal crossFab | 10.46 |
| P1AD4453 | CD40 × FAP 4 + 1 | 47.14 |
| P1AD4574 | CD40 × DP47 4 + 1 | n/a |
| P1AD4455 | CD40 × FAP 4 + 2 | 3.64 |

TABLE 7-continued

Human FAP binding characterization of 28H1 in different bispecific antibody formats

| Molecule | | EC$_{50}$ [nM] |
|---|---|---|
| P1AD4465 | CD40 × DP47 4 + 2 | n/a |
| P1AA9641 | CD40 × FAP 2 + 1 | 32.96 |
| P1AE0408 | CD40 × FAP 2 + 1 head-to-tail | 7.99 |
| P1AA9663 | CD40 × FAP 2 + 2 | 3.65 |
| P1AE0192 | CD40 × FAP 1 + 1 | 1.15 |
| P1AE0889 | CD40 (VH2a/VL2a) × FAP 4 + 1 with C-terminal crossFab | 24.26 |
| P1AE0890 | CD40 (VH2a/VL2a) × FAP 4 + 1 with C-terminal crossFab | 30.42 |

1.4.2 Binding to Human CD40-Expressing Daudi Cells

The binding to cell surface CD40 was tested using Daudi cells, a human B lymphoblast cell line with high expression levels of human CD40 (ATCC CCL-213). Daudi cells were cultured with 1× Dulbecco's Modified Eagle's Medium (DMEM) (Gibco, Cat. No. 42430-025) supplemented with 10% Fetal Bovine Serum (FBS) (life technologies, Cat. No. 16140, Lot No. 1797306A). $0.3 \times 10^5$ Daudi cells were added in 200 µl of 1×DMEM with 10% FBS to each well of a round-bottom 96-well plate (Greiner Bio-One, CELLSTAR®, Cat. No. 650185). Plates were centrifuged 5 minutes at 1700 rpm and supernatants were flicked off. Cells were washed once with 200 µL of 4° C., cold FACS buffer (eBioscience, Cat. No. 00-4222-26). All samples were resuspended in 50 µL/well of 4° C., cold FACS buffer containing the bispecific antigen binding molecules (primary antibody) or isotype control antibody DP47 at the indicated range of concentrations (in duplicates) and incubated for 120 minutes at 4° C. Afterwards the cells were washed three times with 200 µL 4° C., cold FACS buffer. Cells were further stained with 25 µL/well of 4° C., cold secondary antibody solution (1:50 dilution of secondary antibody) containing R-Phycoerythrin (PE) conjugated AffiniPure F(ab')$_2$ Fragment Goat Anti-Human IgG, Fcγ Fragment Specific (Jackson ImmunoResearch, Cat. No. 109-116-098) and incubated for 60 minutes at 4° C., in the dark. Cells were washed with 200 µl FACS buffer and resuspended in 85 L/well FACS-buffer containing 0.2 µg/mL DAPI (Roche, Cat. No. 10236276001) and acquired the same day using a 5-laser LSR-Fortessa (BD Bioscience with DIVA software). Data analysis was performed using the FlowJo version 10 software (FlowJo LLC).

Figure 18:
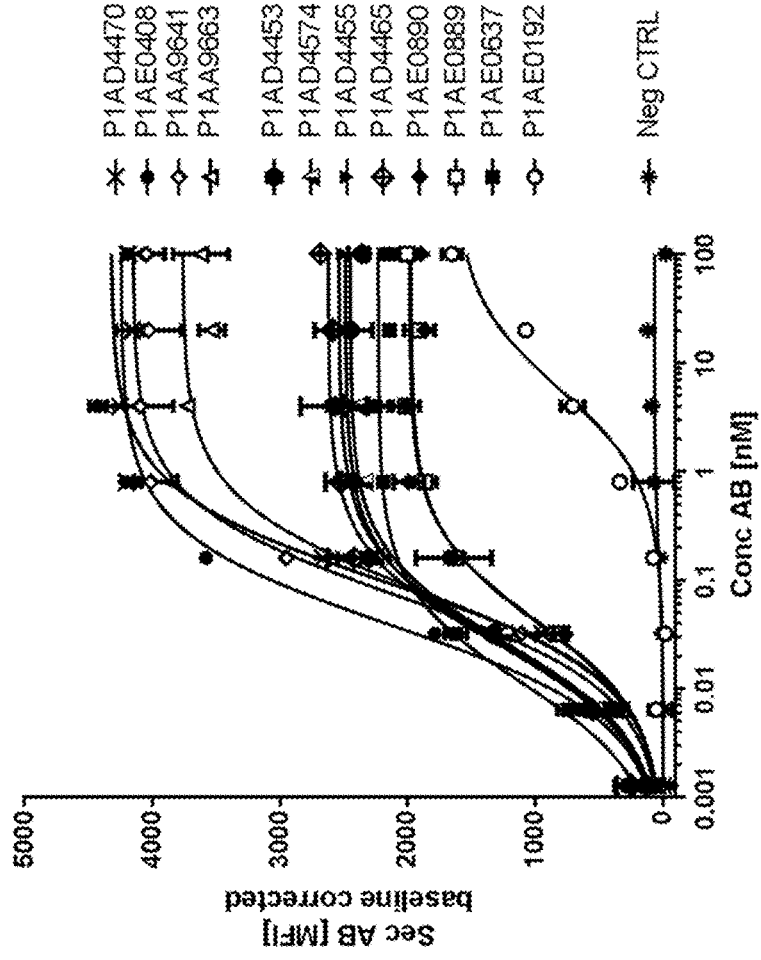
FIG. 18 shows the binding of human tetravalent, bivalent or monovalent anti-CD40) antibodies in a FAP-targeted monovalent or bivalent format to Daudi cells, a B lymphoblast cell line with high surface expression levels of human CD40. All depicted constructs bind to CD40 but vary in their binding strength ($EC_{50}$ values as well as signal strength) to CD40-positive Daudi cells. Bivalent anti-CD40 antibodies show higher $EC_{50}$ levels and reach higher binding plateaus compared to tetravalent anti-CD40 antibodies. The highest $EC_{50}$ value combined with the lowest binding plateau was observed for the 1+1 format. Binding of anti-CD40 antibodies to cell surface proteins was detected with an anti-human IgG Fcγ-specific goat IgG F(ab')$_2$ fragment conjugated to phycoerythrin (PE) using FACS analysis. MFI was measured by flow cytometry and baseline corrected by subtracting the MFI of the blank control. The x-axis shows the concentration of antibody constructs.
Figure 22A:
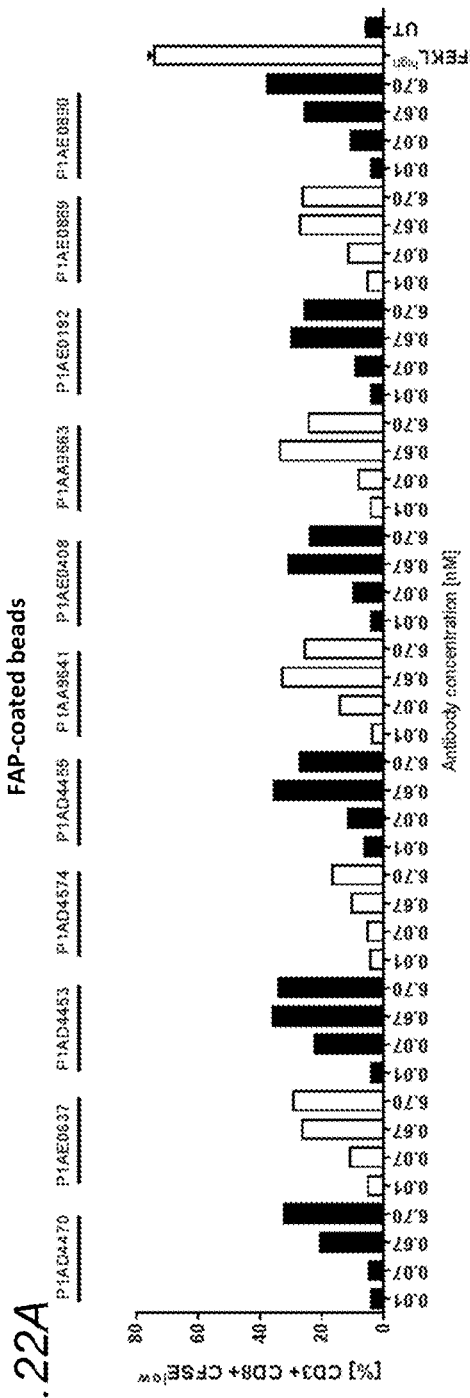
FIG. 22A and FIG. 22B show the T cell priming of OVA-pulsed DCs activated by FAP-targeted anti-CD40) binding molecules in the presence (FIG. 22A) or absence (FIG. 22B) of FAP. DCs isolated from huCD40) transgenic mice, treated with DEC205-OVA conjugate and stimulated with FAP-dependent bispecific anti-CD40) antibodies as well as FAP-coated beads induced a strong proliferation of antigen-specific T cells. In contrast, in the absence of FAP (uncoated beads) no or little T cell proliferation and activation was induced by DCs stimulated with FAP-targeted anti-CD40 antibodies. T cell proliferation induced by DCs stimulated with the human bispecific antigen binding molecules with one, two or four CD40 and one or two FAP binding moieties was comparable. DCs pulsed with high amounts of SIINFEKL instead of DEC205-OVA conjugate induced a strong T cell proliferation. Shown is the percentage of proliferating (CFSE-low) vital CFSE-labeled murine $CD3^+$ $CD8^+$ OT-1 T cells co-cultured with huCD40 tg DCs pre-incubated with the indicated titrated antibodies in the presence of OVA (FIG. 22A and FIG. 22B). The x-axis shows the concentration of antibody constructs.
Figure 22B:
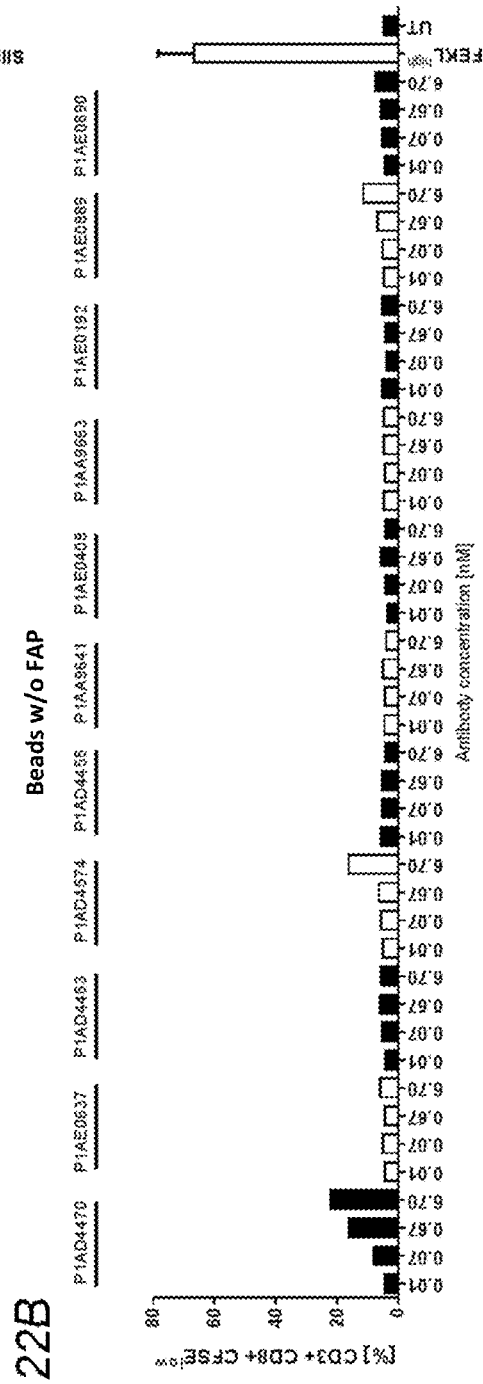

As shown in FIG. 18, all depicted clones bind to CD40 but vary in their binding strength (EC$_{50}$ values as well as signal strength) to CD40-positive Daudi cells. Bivalent anti-CD40 antibodies show higher EC$_{50}$ levels and reach higher binding plateaus compared to tetravalent anti-CD40 antibodies explained by more occupied CD40 binding sites per antibody and a gain of avidity of the tetravalent relative to the bivalent CD40 formats. The highest EC$_{50}$ value combined with the lowest binding plateau was observed for the 1+1 format (P1AE0192). No binding of the negative control antibody to Daudi cells was detected. The EC$_{50}$ values as measured for different bispecific antibodies are shown in Table 8 below.

TABLE 8

Human CD40 binding characterization of CD40 antibodies in different bispecific antibody formats

| Molecule | | $EC_{50}$ [nM] |
|---|---|---|
| P1AD4470 | CD40 IgG1 PGLALA | 0.104 |
| P1AE0637 | CD40 × FAP 4 + 1 with C-terminal crossFab | 0.015 |
| P1AD4453 | CD40 × FAP 4 + 1 | 0.027 |
| P1AD4574 | CD40 × DP47 4 + 1 | 0.031 |
| P1AD4455 | CD40 × FAP 4 + 2 | 0.030 |
| P1AD4465 | CD40 × DP47 4 + 2 | 0.036 |
| P1AA9641 | CD40 × FAP 2 + 1 | 0.079 |
| P1AE0408 | CD40 × FAP 2 + 1 head-to-tail | 0.044 |
| P1AA9663 | CD40 × FAP 2 + 2 | 0.096 |
| P1AE0192 | CD40 × FAP 1 + 1 | 21.628 |
| P1AE0889 | CD40 (VH2a/VL2a) × FAP 4 + 1 with C-terminal crossFab | 0.046 |
| P1AE0890 | CD40 (VH2a/VL2a) × FAP 4 + 1 with C-terminal crossFab | 0.048 |

Example 2

Functional Properties of FAP-Targeted Anti-Human CD40 Binding Molecules 2.1 CD40-Mediated Activation of Antigen Presenting Cells (APCs) by FAP-Targeted Anti-Human CD40 Binding Molecules Ligation of CD40 induces B cell and dendritic cell (DC) maturation as well as activation and promotes survival of these cell types. Upon CD40 signaling cytokine production and costimulatory molecule expression on the surface of B cells and DCs is increased (S. Quezada et al., Annu RevImmunol. 2004, 22, 307-328; S. Danese et al., Gut. 2004, 53, 1035-1043; G. Bishop et al., Adv Exp Med Biol. 2007, 597, 131-151).

In order to test the agonistic properties and the FAP specificity of the different FAP-dependent anti-CD40 antibodies, APCs obtained from human buffy coats were incubated with the FAP-dependent agonistic anti-human CD40 antibodies and either FAP-coated beads or human FAP expressing NIH/3T3 cells. APC activation was measured by FACS and supernatant of the cells was analyzed for cytokines by enzyme-linked immunosorbent assay (ELISA).

2.1.1 Activation of Human B Cells by FAP-Targeted Anti-Human CD40 Binding Molecules Using NIH/3T3-huFAP Cells as Source of Antigen NIH/3T3 cells expressing FAP were used as source of antigen for the bispecific antigen binding molecules. The NIH/3T3-huFAP cells were generated by transfection of mouse embryonic fibroblast NIH/3T3 cells (ATCC CRL-1658) with the expression pETR4921 plasmid encoding human FAP under a CMV promoter. The NIH/3T3-huFAP cells or NIH/3T3-wt cells were irradiated with 27 Gy using a RS 2000 irradiator (Rad Source Technologies to prevent the cells from proliferating. $0.2 \times 10^5$ irradiated NIH/3T3 cells in 100 µl of R10 medium consisting of Roswell Park Memorial Institute medium (RPMI) 1640 (Gibco, Cat. No. 31870-025) supplied with 10% FBS, 1% (v/v) Penicillin Streptomycin (Gibco, Cat. No. 15070-063), 1% (v/v) L-Glutamine (Gibco, Cat. No. 25030-024), 1% (v/v) Sodium-Pyruvate (Gibco, Cat. No. 11360-039), 1% (v/v) MEM non-essential amino acids (Gibco, Cat. No. 11140-035) and 50 µM β-Mercaptoethanol (Gibco, Cat. No. 31350-010) were seeded per well of a 96-well flat-bottom plate (TPP, Cat. No. 92696).

On the next day a buffy coat was obtained from the Stiftung Zürcher Blutspendedienst SRK. In order to isolate peripheral blood mononuclear cells (PBMCs). 50 mL of buffy coat were diluted in the same volume of PBS (Gibco. Cat. No. 10010023). 50 mL polypropylene centrifuge tubes (TPP. Cat. No. 91050) were supplied with 15 mL of LYMPHOPREP™ (STEMCELL Technologies. Cat. No. 07851) and 25 mL of the buffy coat/PBS solution per tube were carefully layered above the LYMPHOPREP™. The tubes were centrifuged at 2000 rpm for 24 minutes at room temperature with low acceleration and without break. Afterwards the PBMCs were collected from the interface, washed three times with PBS, resuspended in 10) mL of PBS and cells were analyzed for cell type and number with a Beckman Coulter cell counter Ac·T™ 5diff OV (Beckman Coulter. Cat. No. 6605580). Prior to the B cell isolation from the PBMCs, the CD14-positive fraction was removed by magnetic labeling of the CD14-positive cells with CD14 microbeads (Miltenyi. Cat. No. 130)-050)-201) and subsequent isolation with the AUTOMACS R Pro Separator (Miltenyi. Cat. No. 130-0) 92-545). The CD14-negative fraction was used for subsequent B cell isolation with the Miltenyi B cell isolation kit II (Cat. No. 130-091-151) and AUTOMACS R separation. $1 \times 10^5$ B cells were added in 50 µl of R10 medium per well to the NIH/3T3 cells. FAP-targeted anti-human CD40) antibodies were added in 50 µl of R10 medium to the B cells at concentrations ranging from 1 µg/mL to 0.3 ng/ml (3× dilution series). As positive control, the FAP-independent agonistic anti-human CD40) antibodies RO7009789 (IgG2. INN: Selicrelumab) and SGN-40) (IgG1. INN: Dacetuzumab) were used. Both antibodies are bivalent for CD40. Since it is described in the literature that the SGN-40 antibody requires Fc receptor cross-linking for biological activity (C. Law et al., *Cancer Res* 2005, 65, 8331-8338), a mechanism that is as well under discussion for RO7009789 (R. Dahan et al., *Cancer Cell* 2016, 29, 1-12), these two antibodies were incubated with a cross-linking goat anti-human IgG Fcγ fragment specific F(ab')₂ fragment (Jackson ImmunoResearch. Cat. No. 109-006-008) for 30 minutes before addition to the B cells. After 48 hours cells were transferred into a 96-well round-bottom plate, washed once with PBS and incubated with 50 µl of 3 µg/mL of Fc receptor blocking Mouse IgG Isotype Control (ThermoFisher Scientific, Cat. No. 10400C) in PBS. After 15 minutes of incubation at 4° C., cells were washed with PBS and 50 µl of a mixture of fluorescently labelled antibodies in PBS was added to the cells. The following fluorescently labelled antibodies were used: anti-human CD83 BV421 (Biolegend, clone HB15e. Cat. No. 305324), anti-human CD80) BV605 (BD Biosciences, clone L307.4. Cat. No. 563315), anti-HLA-ABC FITC (BD Biosciences, clone G46-2.6. Cat. No. 555552), anti-human CD14 PerCP-Cy5.5 (Biolegend, clone HCD14, Cat. No. 325622), anti-human CD3 PerCP-Cy5.5 (Biolegend, clone UCHT1. Cat. No. 300430), anti-human CD70) PE (Biolegend, clone 113-16. Cat. No. 35510) 4), anti-human CD86 PE-CF594 (BD Biosciences, clone FUN-1, Cat. No. 562390)), anti-HLA-DR APC (BD Biosciences, clone G46-6. Cat. No. 559866) and anti-human CD19 APC-H7 (BD Biosciences, clone SJ25C1. Cat. No. 560177). In order to distinguish between live and dead cells, the viability dye ZOMBIE AQUA™ (Biolegend. Cat. No. 423102) was added to the antibody mixture. After 30 minutes of incubation at 4° C., cells were washed twice with PBS and then resuspended in 200 µl of PBS. Cells were analyzed the same day using a 5-laser LSR-Fortessa (BD Bioscience with DIVA software). Data analysis was performed using the FlowJo version 10 software (FlowJo LLC). Live (aqua negative) cells, negative for CD14 and CD3 and positive for CD19 were analyzed for CD70. CD80. CD83 and CD86 expression.

Figure 3C:
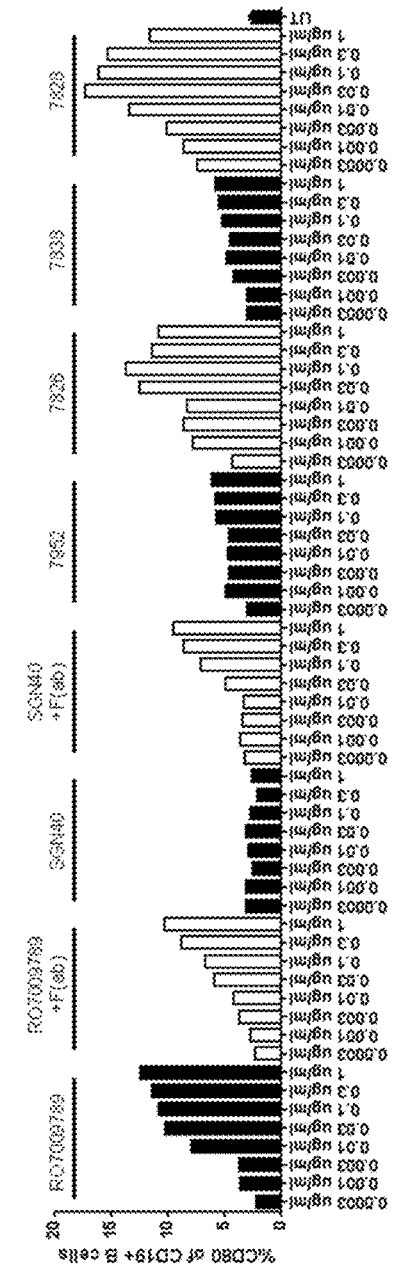
Figure 3D:
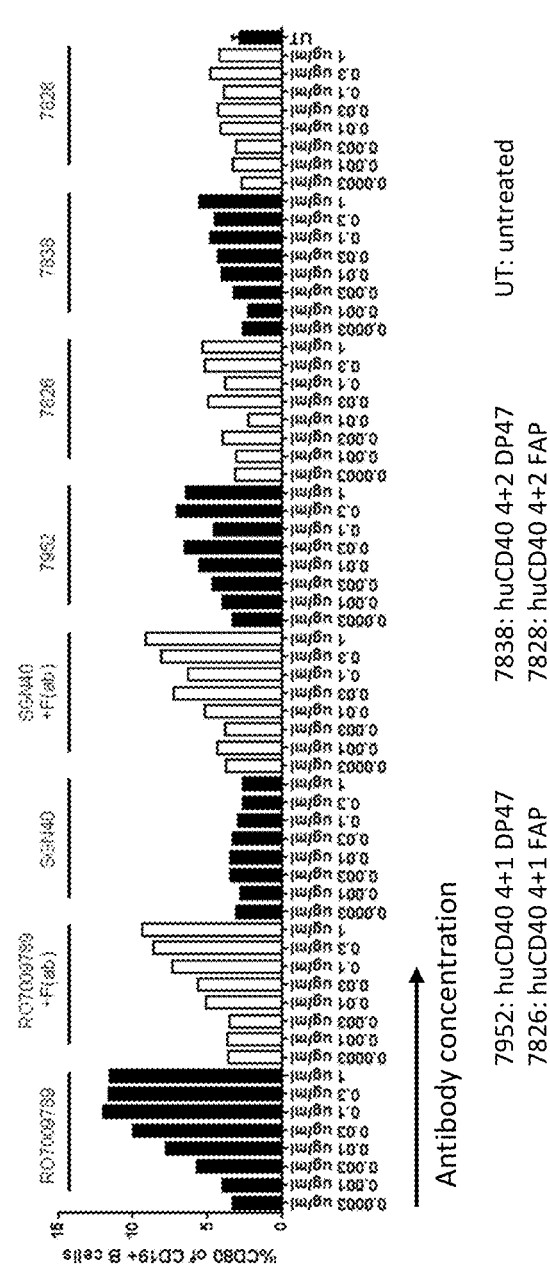
Figure 3E:
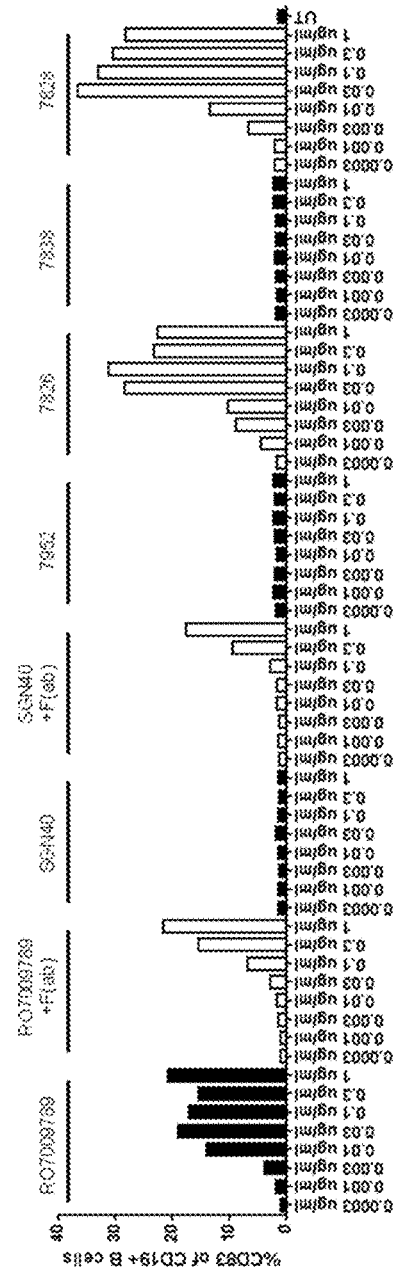
Figure 3F:
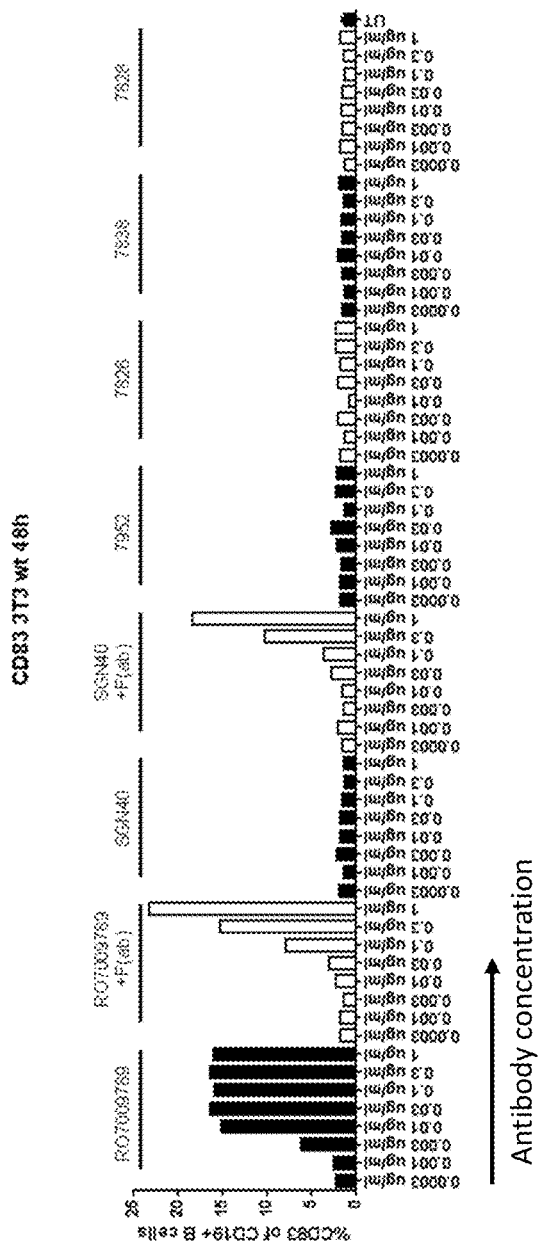
Figures 3G, 3H:
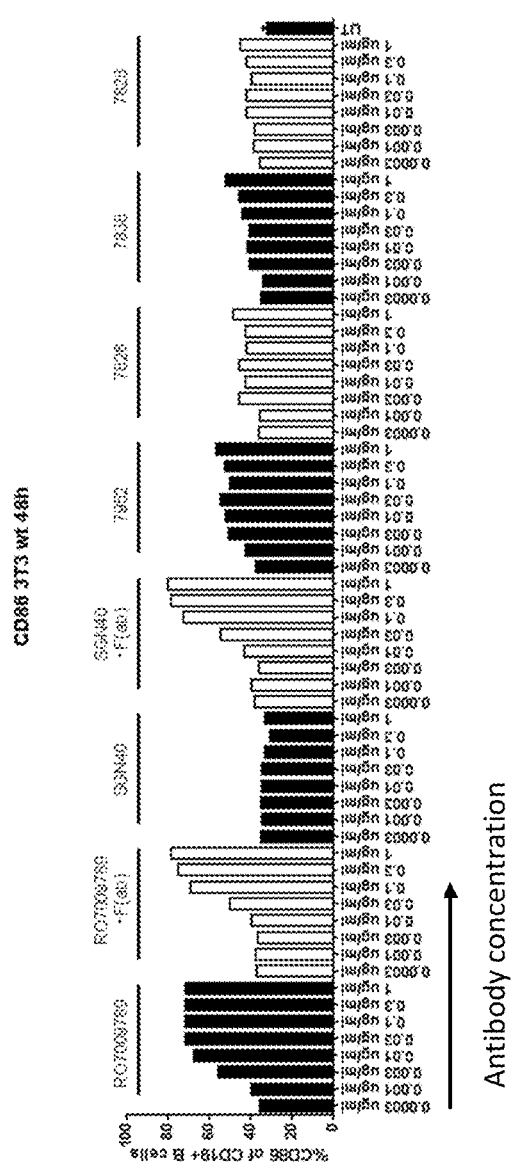
Figure 4C:
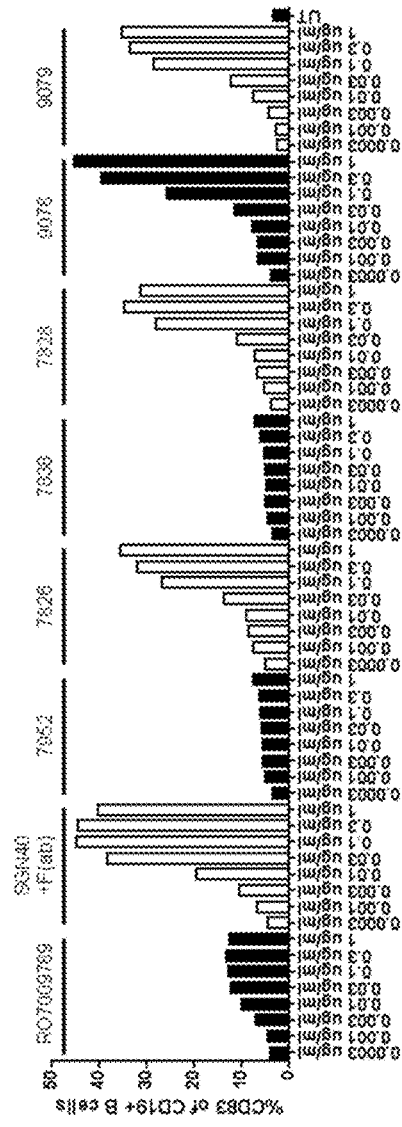
Figure 4D:
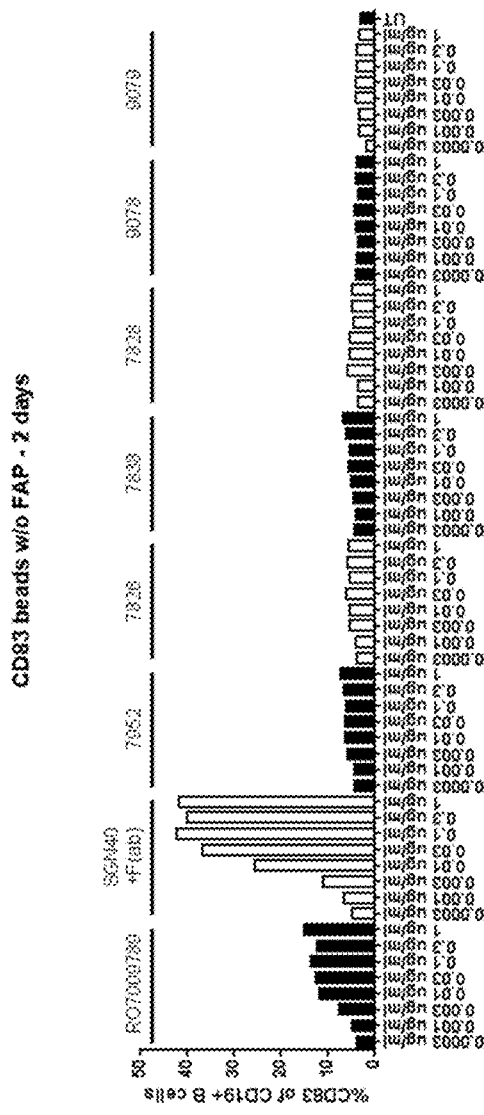
Figure 4E:
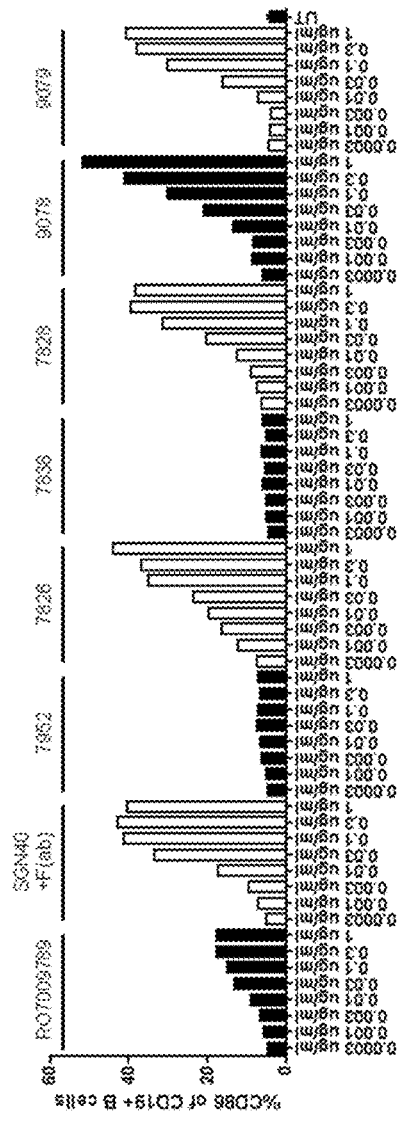
Figure 4F:
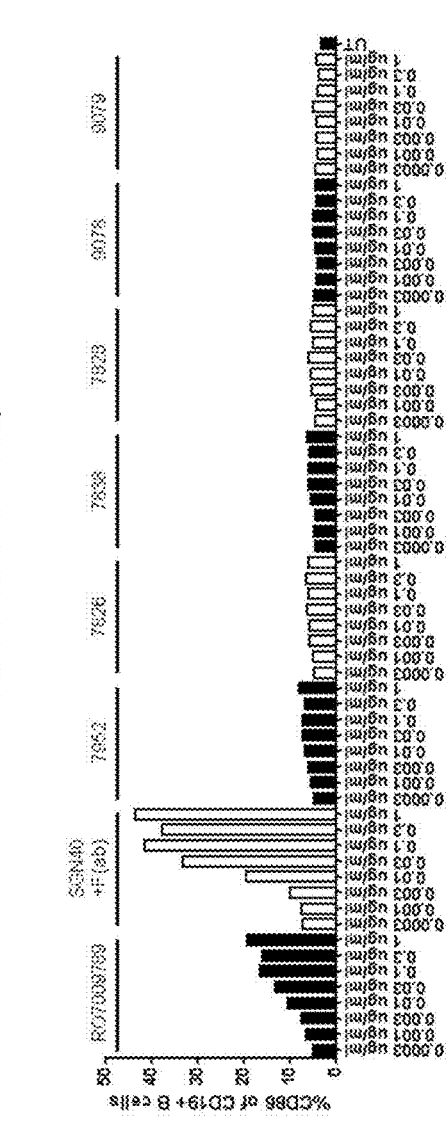
Figures 5A, 5B:
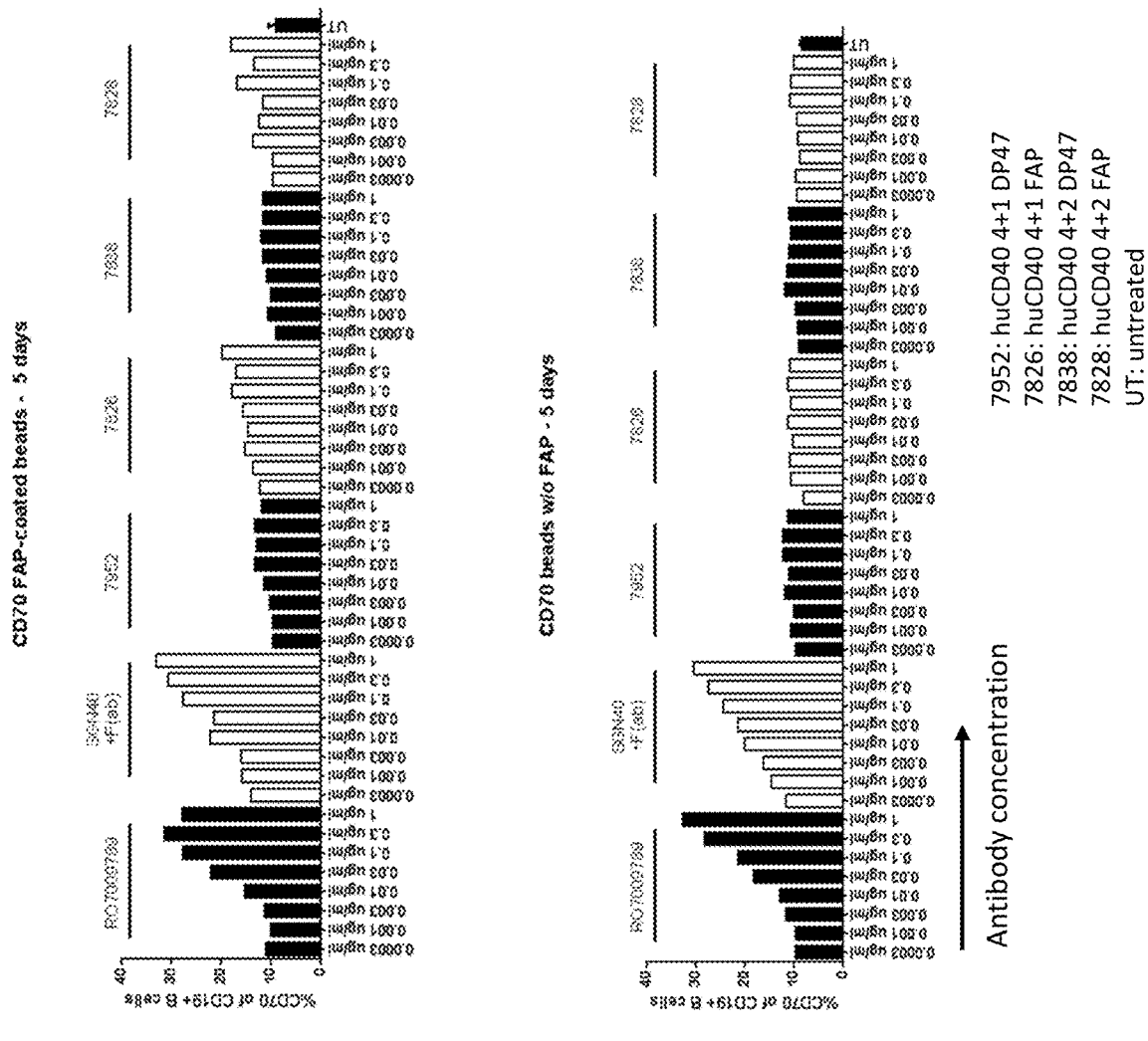
Figure 5C:
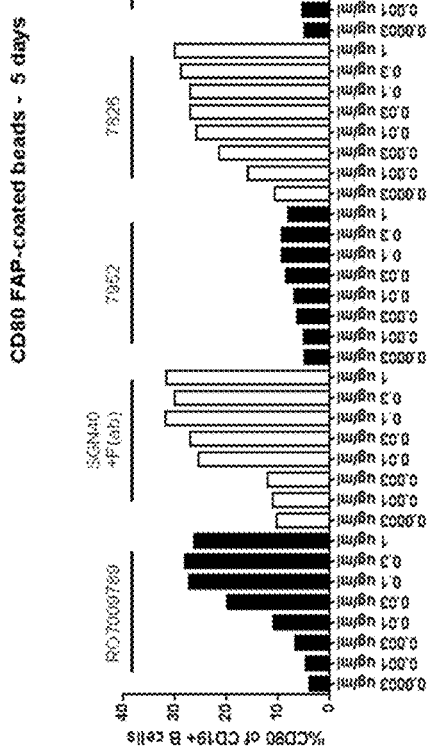
Figure 5D:
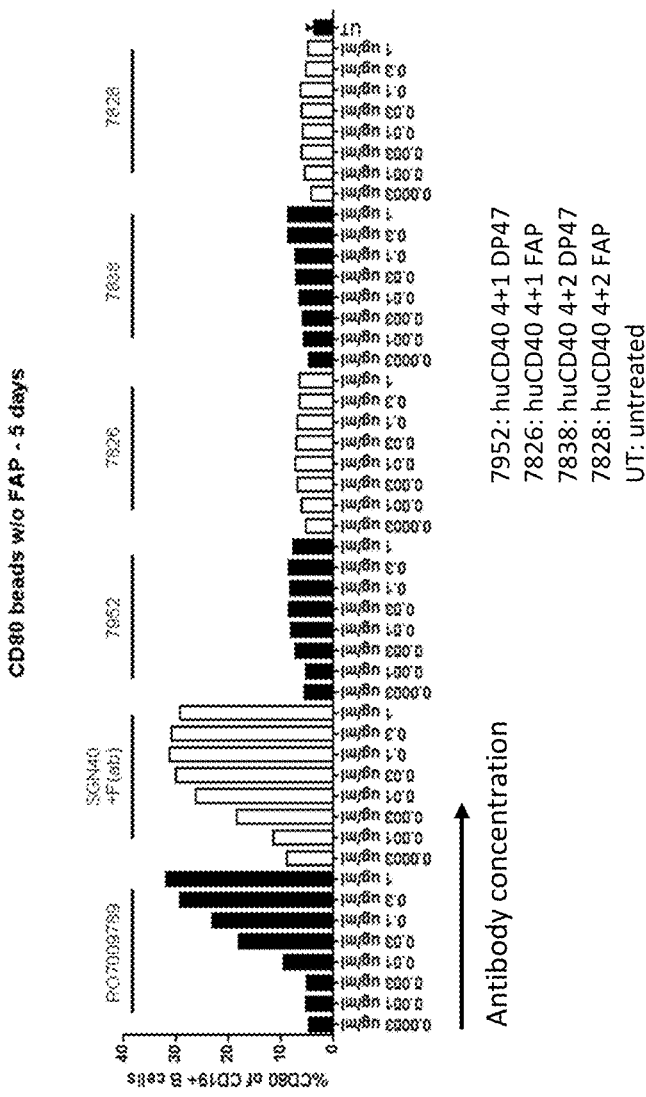
Figures 5E, 5F:
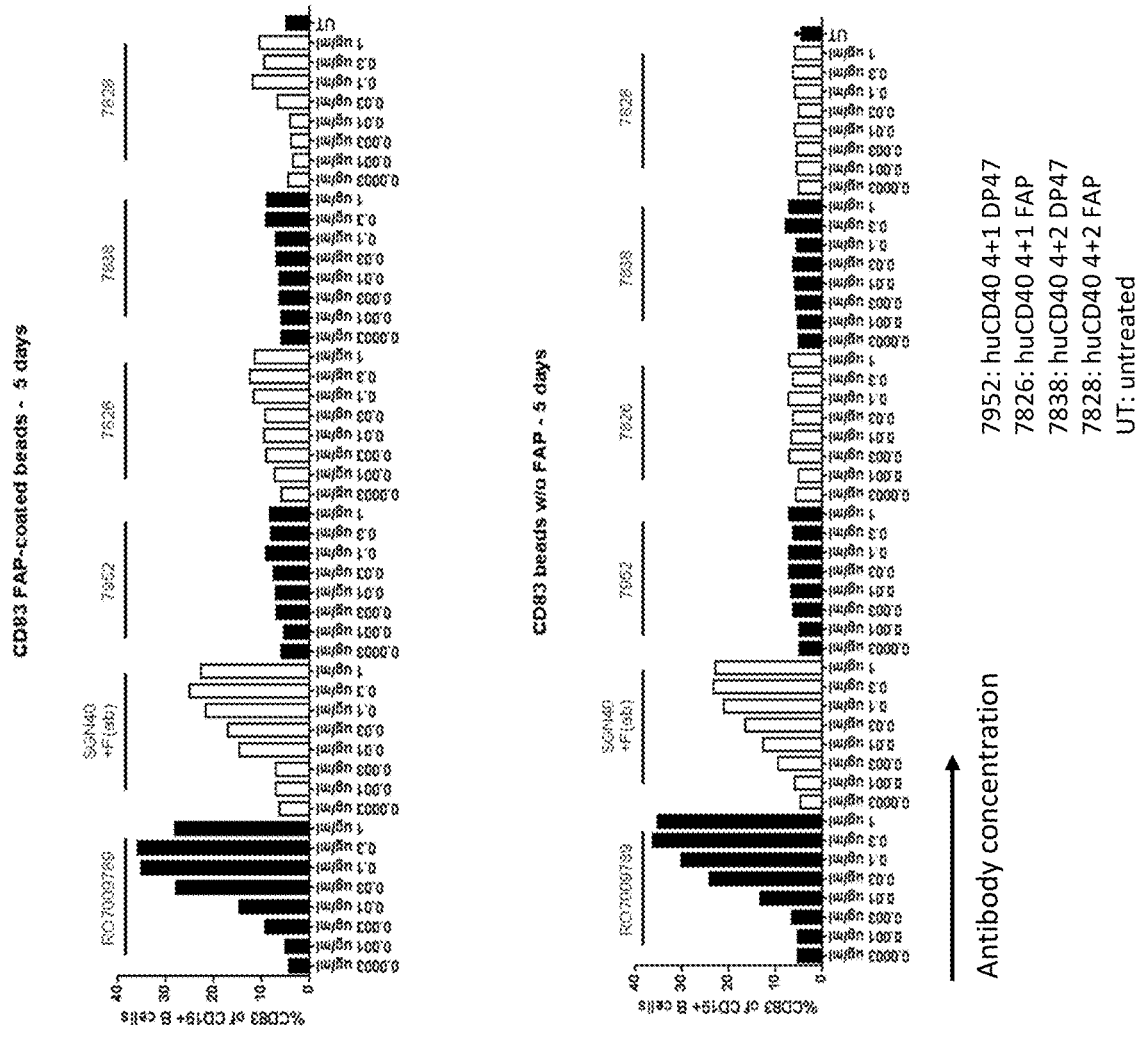
Figure 5G:
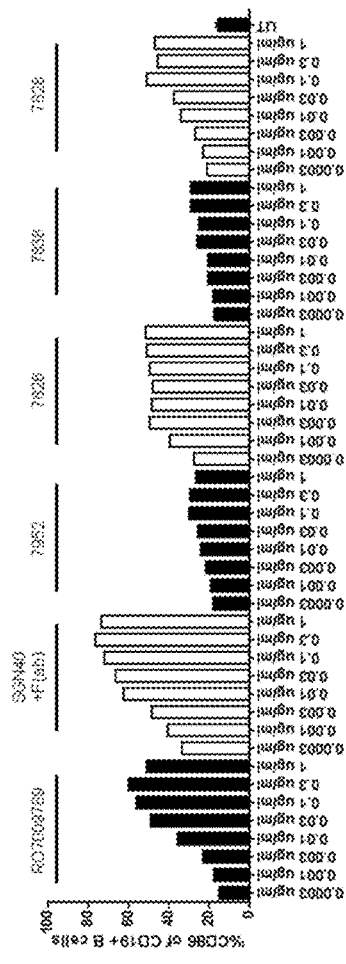
Figure 5H:
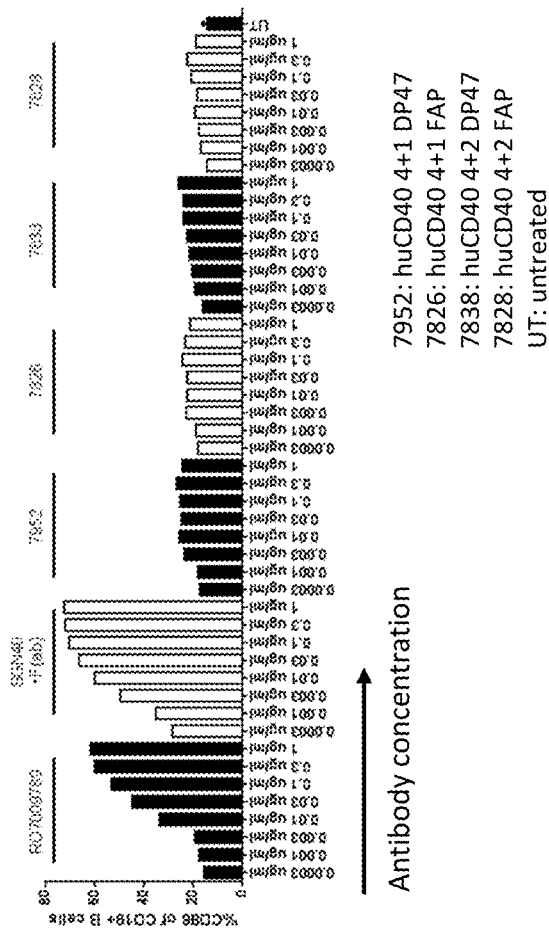

FIG. 3A, FIG. 3B, FIG. 3C, D, FIG. 3E, FIG. 3F, FIG. 3G, and FIG. 3H show the FAP-dependent upregulation of B cell activation markers CD70) (FIG. 3A and FIG. 3B). CD80) (FIG. 3C and FIG. 3D). CD83 (FIG. 3E and FIG. 3F) and CD86 (FIG. 3G and FIG. 3H) by bispecific antigen binding molecules tetravalent for human CD40) and either mono- or bivalent for FAP. The bispecific antibody monovalent for FAP induced a similar increase of activation marker expression as the molecule with two FAP binding moieties. With NIH/3T3-FAP cells upregulation of the B cell activation markers by the bispecific antigen binding molecules was comparable to the upregulation induced by the FAP-independent positive control antibodies. Without FAP present (NIH/3T3-wt cells) no increase of B cell activation markers was observed with the bispecific antigen binding molecules, while positive control antibodies induced an upregulation in the expression of these markers.

2.1.2 Activation of Human Daudi Cells by FAP-Targeted Anti-Human CD40 Binding Molecules Using FAP-Coated DYNABEADS® as Source of Antigen $1 \times 10^5$ Daudi cells in 100 µl of 1× DMEM plus 10% FBS were added per well of a 96-well flat-bottom plate. Instead of using cells expressing FAP as source of antigen, streptavidin DYNABEADS® (ThermoFisher Scientific. Cat. No.: 11205D) were coated with biotinylated mouse FAP (produced in-house) (binding capacity of $6.5 \times 10^4$ beads: 0.01 µg of protein) according to the manufacturer's instructions and added to the Daudi cells in a bead: cell ratio of 2:1 in 50 µl of R10 medium. Usage of beads coated with FAP instead of FAP-expressing cells provides a more stable and reproducible system, since fluctuating quality of the cells and secretion of cellular products that might influence APC activation status represent factors that potentially distort results. As control non-coated beads were added to the Daudi cells. FAP-targeted anti-human CD40) antibodies or positive control antibodies (described in section 2.1.1) were added in 50 µl of R10 medium to the Daudi cells. After 2 days Daudi cells were analyzed by FACS following the staining and analysis procedures specified in 2.1.1.

B cells analyzed after 2 days of incubation with agonistic anti-CD40) antibodies showed an increase in CD70 expression for all antibodies (see FIG. 20A and FIG. 20B). The $EC_{50}$ values of specific molecules are summarized in Table 9 below. Upregulation of these expression markers was dependent on FAP in case of the different FAP-targeted antibodies and increase of expression induced by these FAP-dependent antibodies was higher compared to the increase induced by the cross-linked CD40 antibody (P1AD4470). In the absence of FAP (uncoated beads) no increase of CD70 was observed with the depicted bispecific antibodies mono- or bivalent for CD40, while tetravalent CD40 binding molecules induced an upregulation of CD70, but to a lesser extent than in the presence of FAP indicating a low but detectable FAP-independent CD40 activation of tetravalent CD40 binder in Daudi cells.

TABLE 9

Activation of human Daudi cells using FAP-coated DYNABEADS ®

| Molecule | | $EC_{50}$ [nM] |
|---|---|---|
| P1AD4470 | CD40 IgG1 | 0.756 |
| P1AE0637 | CD40 × FAP 4 + 1 with C-terminal crossFab | 0.029 |

TABLE 9-continued

Activation of human Daudi cells using FAP-coated DYNABEADS ®

| Molecule | | $EC_{50}$ [nM] |
|---|---|---|
| P1AD4453 | CD40 × FAP 4 + 1 | 0.015 |
| P1AD4574 | CD40 × DP47 4 + 1 | 0.166 |
| P1AD4455 | CD40 × FAP 4 + 2 | 0.039 |
| P1AD4465 | CD40 × DP47 4 + 2 | n/a |
| P1AA9641 | CD40 × FAP 2 + 1 | 0.068 |
| P1AE0408 | CD40 × FAP 2 + 1 head-to-tail | 0.094 |
| P1AA9663 | CD40 × FAP 2 + 2 | 0.124 |
| P1AE0192 | CD40 × FAP 1 + 1 | 0.409 |
| P1AE0889 | CD40 (VH2a/VL2a) × FAP 4 + 1 with C-terminal crossFab | 0.055 |
| P1AE0890 | CD40 (VH2a/VL2a) × FAP 4 + 1 with C-terminal crossFab | 0.058 |

2.1.3 Activation of Human B Cells by FAP-Targeted Anti-Human CD40 Binding Molecules Using FAP-Coated DYNABEADS® as Source of Antigen B cells were isolated from buffy coats as described in section 2.1.1 and $1 \times 10^5$ B cells in 100 µl of R10 medium were added per well of a 96-well flat-bottom plate. Streptavidin DYNABEADS® (ThermoFisher Scientific, Cat. No.: 11205D) were coated with biotinylated human or mouse FAP (produced in-house) (binding capacity of $6.5 \times 10^4$ beads: 0.01 µg of protein) according to the manufacturer's instructions and added to the B cells in a bead: cell ratio of 2:1 in 50 µl of R10 medium. As control non-coated beads were added to the B cells. The FAP-targeted anti-human CD40 antibodies or positive control antibodies (described in section 2.1.1) were added in 50 µl of R10 medium to the B cells. After 2 days B cells were analyzed by FACS following the staining and analysis procedures specified in 2.1.1. Alternatively B cells were cultured for five days in presence of the agonistic anti-CD40 antibodies and 110 µl supernatant were taken for IL-6 measurement using the human IL-6 DUOSET® ELISA kit (R&D, Cat. No. DY206-05). It is known that B cells produce increased amounts of IL-6 upon stimulation with the CD40 ligand without the need of additional B cell receptor stimuli (M. Duddy et al., J. Immunol. 2004, 172, 3422-3427). The ELISA was performed as described in the protocol provided by the manufacturer with the only difference of using half of the recommended amounts for every step of the assay. B cells were analyzed by FACS following the staining and analysis procedures specified in section 2.1.1.

B cells analyzed after 2 days of incubation with agonistic anti-CD40 antibodies showed an increase in CD70, CD83 and CD86 expression for all antibodies (see FIG. 4A, FIG. 4B, FIG. 4C, FIG. 4D, FIG. 4E, FIG. 4F, FIG. 21A and FIG.B and FIG. 25A, FIG. 25B, FIG. 25C, FIG. 25D). The $EC_{50}$ values relating to the increase of CD86 expression of specific molecules are summarized in Table 10 below. Upregulation of these expression markers was dependent on FAP in case of the different FAP-targeted antibodies and increase of expression induced by these FAP-dependent antibodies was comparable or slightly lower to the increase induced by the cross-linked CD40 antibody P1AD4470.

TABLE 10

Activation of human B cells using FAP-coated DYNABEADS ® shown as increase of CD86 expression

| Molecule | | EC$_{50}$ [nM] |
|---|---|---|
| P1AD4470 | CD40 IgG1 | 0.072 |
| P1AE0637 | CD40 × FAP 4 + 1 with C-terminal crossFab | 0.202 |
| P1AD4453 | CD40 × FAP 4 + 1 | 0.280 |
| P1AD4574 | CD40 × DP47 4 + 1 | n/a |
| P1AD4455 | CD40 × FAP 4 + 2 | 0.325 |
| P1AD4465 | CD40 × DP47 4 + 2 | n/a |
| P1AA9641 | CD40 × FAP 2 + 1 | 0.909 |
| P1AE0408 | CD40 × FAP 2 + 1 head-to-tail | 0.658 |
| P1AA9663 | CD40 × FAP 2 + 2 | 1.004 |
| P1AE0192 | CD40 × FAP 1 + 1 | 0.742 |
| P1AE0889 | CD40 (VH2a/VL2a) × FAP 4 + 1 with C-terminal crossFab | 0.329 |
| P1AE0890 | CD40 (VH2a/VL2a) × FAP 4 + 1 with C-terminal crossFab | 0.345 |

After 5 days of B cell incubation with FAP-coated DYNABEADS®, antigen binding molecules targeting human CD40) and FAP induced a FAP-dependent upregulation of CD80 expression on B cells. The levels of CD80 expression induced by anti-human CD40) antibodies with either one or two FAP binding sites were comparable. Treatment of B cells with positive control anti-CD40) antibodies led to a similar extent of CD80 upregulation. Elevated. FAP-dependent CD86 expression could be as well detected with the bispecific antigen binding molecules. Again, presence of one or two FAP binding sites made no major difference in expression levels of this activation marker. Compared to the FAP-independent upregulation of CD86 induced by cross-linked SGN-40 (dacetuzumab) or agonistic CD40 antibody selicrelumab (RO 7009789). CD86 upregulation induced by FAP-dependent bispecific antigen binding molecules was slightly lower. For CD70 and CD83 no or only very limited upregulation was observed with the bispecific antibodies targeting FAP and CD40, while the positive control antibodies clearly showed an effect on these B cell activation markers (FIG. 5A, FIG. 5B, FIG. 5C, FIG. 5D, FIG. 5E, FIG. 5F, FIG. 5G, FIG. 5H).

Figures 6A, 6B:
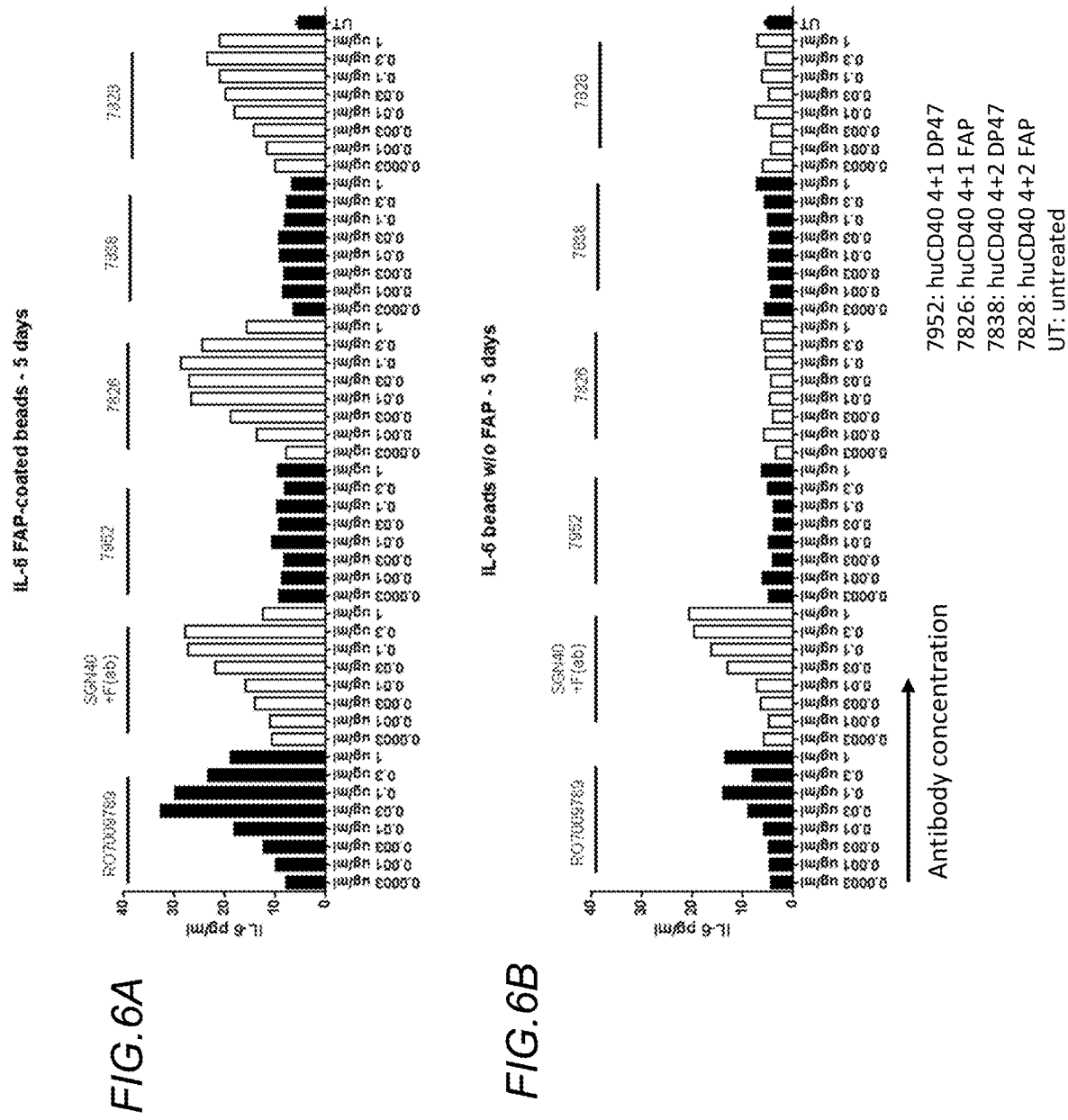
FIG. 6A and FIG. 6B show the IL-6 secretion of human B cells treated with different FAP-targeted and untargeted agonistic anti-CD40 antibodies in the presence of FAP-coated (FIG. 6A) or uncoated beads (FIG. 6B) after 5 days incubation. In the presence of FAP the monovalent as well as the bivalent FAP-targeted anti-CD40 antibody induced a similar increased IL-6 secretion as compared to the FAP-independent positive control antibodies RO7009789 and SGN40. In contrast. B cells treated with the untargeted negative control antibodies expressed similar low IL-6 levels as untreated B cells. In the absence of FAP (uncoated beads) no increase in IL-6 production was detected with the bispecific antigen binding molecules. Shown is the IL-6 amount in the supernatant of human B cells cultured for five days with the indicated titrated antibodies measured by ELISA. The x-axis shows the concentration of antibody constructs.

FIG. 6A and FIG. 6B show the effects of different agonistic anti-CD40 antibodies on B cell IL-6 production. With FAP present IL-6 concentration in the supernatants were elevated to a similar extent for all agonistic anti-human CD40) antibodies tested (about 6-fold increase compared to untreated (UT) conditions). Upon incubation of the B cells with non-coated DYNABEADS® no increase in IL-6 production was detected with the bispecific antigen binding molecules, demonstrating FAP-dependency of these molecules. 20)

2.1.4 Activation of Human Monocyte-Derived DCs (moDCs) by FAP-Targeted Anti-Human CD40 Binding Molecules Using Human FAP-Coated DYNABEADS® as Source of Antigen PBMCs were isolated from buffy coats by LYMPHOPREP™ density centrifugation. Subsequently monocytes were isolated with CD14 microbeads and AUTOMACS® separation as described in 2.1.1. In order to generate monocyte-derived DCs (moDCs). 3×10$^6$ monocytes were seeded per well of a 6 well plate (TPP. Cat. No. 92006) with a density of 1×10$^6$ cells per mL. For DC maturation moDC medium consisting of RPMI 1640 supplemented with 1% (v/v) Penicillin Streptomycin. 2% (v/v) human serum (heat inactivated for 30 minutes at 56° C.) (Sigma-Aldrich. Cat. No. H4522. Lot. No. SLBP1687V). 20 ng/mL freshly added recombinant human granulocyte macrophage colony-stimulating factor (GM-CSF) (Peprotech, Cat. No. 300)-0) 3-20UG. Lot No. 081230H1213) and 20 ng/ml of freshly added recombinant human IL-4 (Peprotech. Cat. No. 200-04-100UG. Lot. No. 091514C3116) was used. After five days moDCs were harvested from the 6-well plates by gentle removal of suspension and semi-adherent cells and resuspended in fresh moDC medium containing human IL-4 and GM-CSF. 2×10$^5$ moDCs were seeded in 100 µl of moDC medium per well of a 96-well flat-bottom plate. Streptavidin DYNABEADS® were coated with biotinylated human FAP and added in 50 µl in a bead/DC ratio of 2:1 (as described in 2.1.3). As control non-coated beads were added to the moDCs. FAP-targeted anti-human CD40 antibodies were added in 50 µl to the DCs at concentrations ranging from 1 µg/mL to 0.3 ng/ml (3× dilution series). As positive. FAP-independent controls the agonistic anti-human CD40 antibody RO7009789 and the cross-linked CD40 antibody were used. Two days after addition of the DYNABEADS® and of the different agonistic anti-human CD40 antibodies moDC activation was measured by FACS. FACS staining was performed as specified in 2.1.1 using a mixture of fluorescently labelled antibodies consisting of anti-human CD86 BV421 (BD Biosciences, clone FUN-1. Cat. No. 562432), anti-human CD80 BV605 (BD Biosciences, clone L307.4. Cat. No. 563315), anti-HLA-ABC FITC (BD Biosciences, clone G46-2.6. Cat. No. 555552), anti-human CDIc PerCp-Cy5.5 (BD Biosciences, clone F10/21A3. Cat. No. 565424), anti-human CD70) PE (Biolegend, clone 113-16, Cat. No. 355104), anti-human CD11c PE-eF610 (eBioscience, clone 3.9. Cat. No. 61-0116-42), anti-human CD83 PE-Cy7 (BD Biosciences, clone HB15e. Cat. No. 561132), anti-human CD209 APC (BD Biosciences, clone DCN46. Cat. No. 551545), anti-human CD3 Alexa Fluor 700 (eBioscience, clone OKT3. Cat. No. 56-0037-42), anti-human CD14 APC-H7 (BD Biosciences, clone M5E2. Cat. No. 561384) and viability dye ZOMBIE AQUA™ (Biolegend. Cat. No. 423102). Cells were analyzed the same day using a 5-laser LSR-Fortessa. Data analysis was performed using the FlowJo version 10 software. Single, live cells were gated for CD3 negative and CD14 negative cells. Based on this population CDIc and CD11c positive cells were analyzed for the expression of the activation markers CD70. CD80. CD83 and CD86.

Figures 7C, 7D:
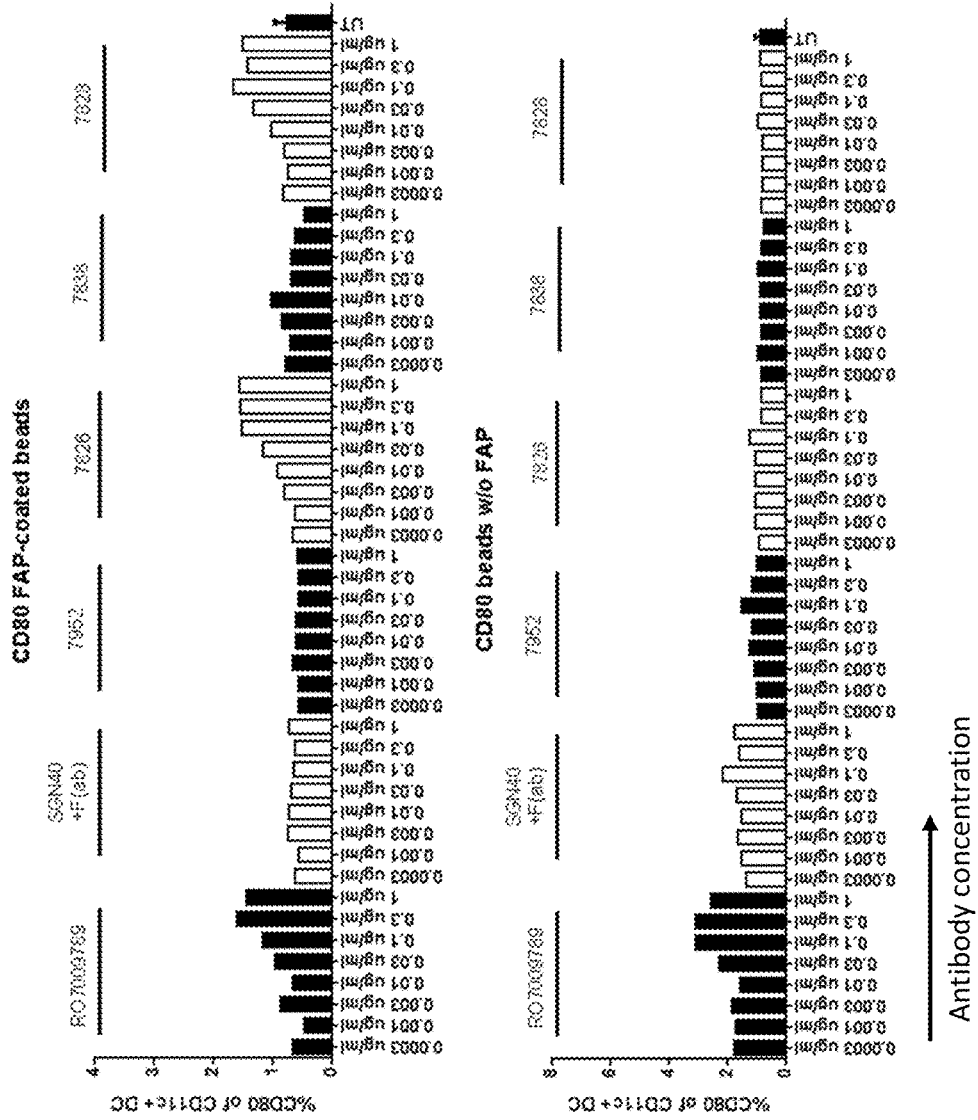
Figures 7E, 7F:
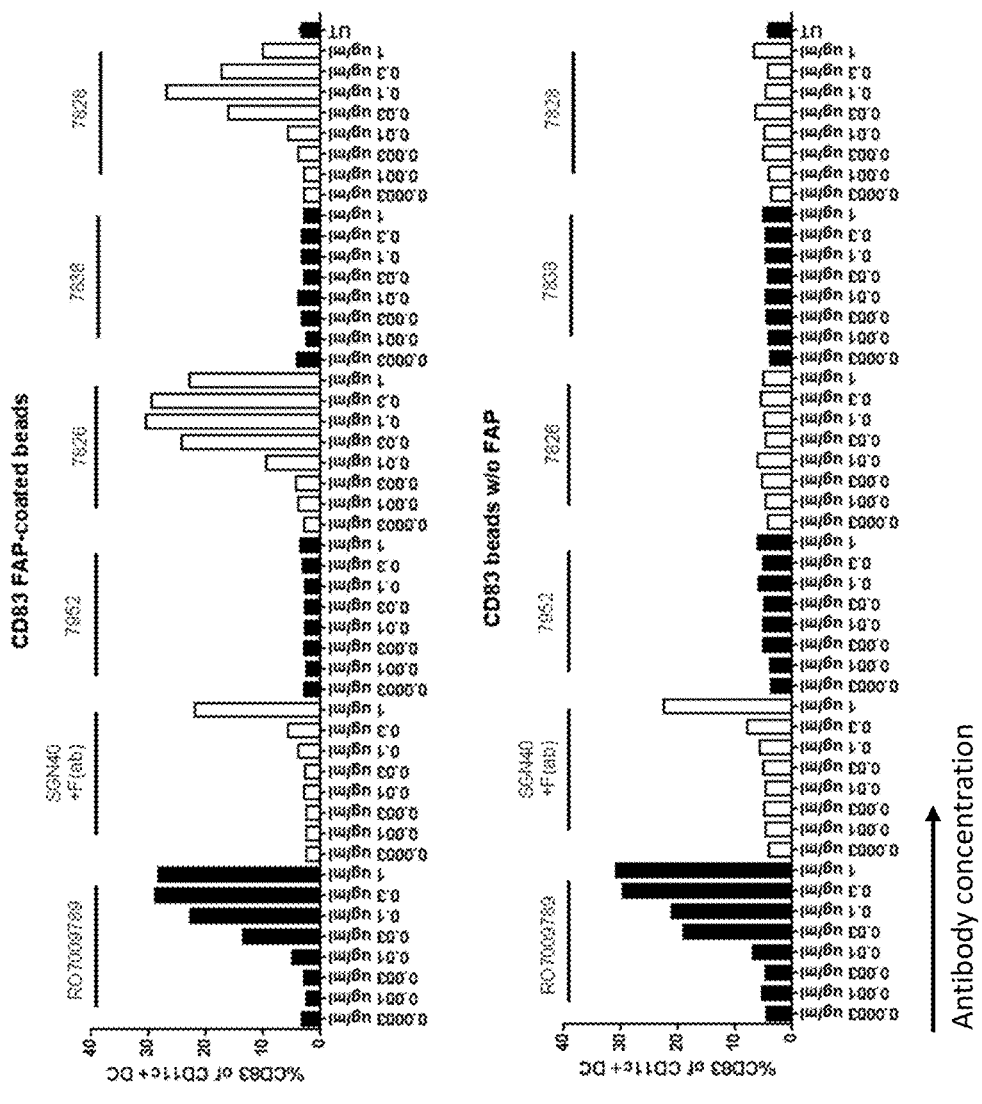
Figure 7G:
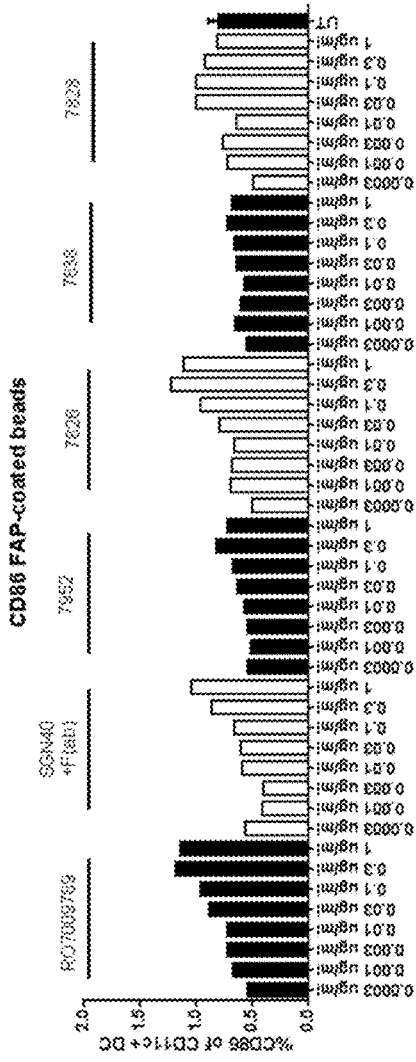
Figure 7H:
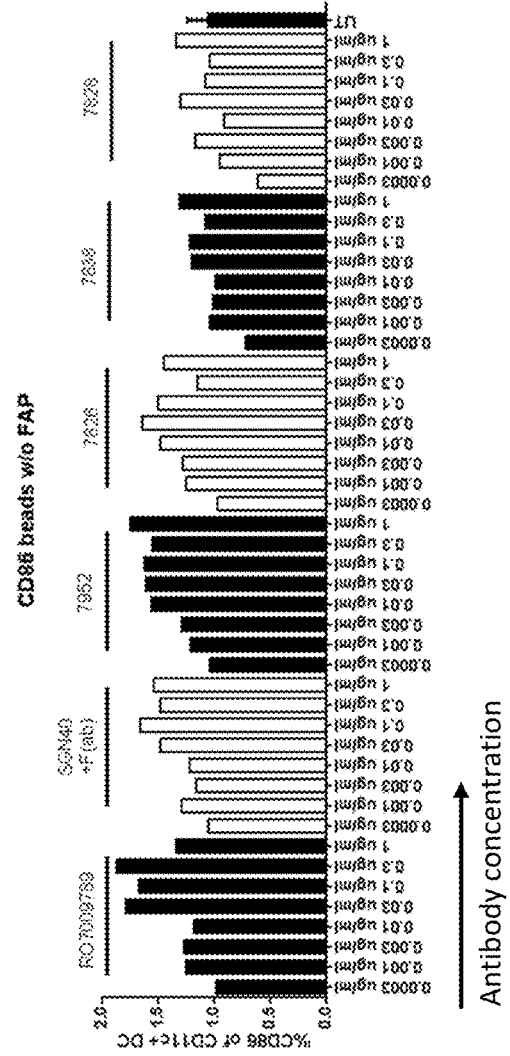

For all agonistic anti-human CD40 antibodies a pronounced and similar upregulation of CD83 on moDCs could be observed (FIG. 7A, FIG. 7B, FIG. 7C, FIG. 7D, FIG. 7E, FIG. 7F). In case of the FAP-dependent anti-CD40 antibodies, this upregulation was detected in a FAP-dependent manner. With the bispecific antigen binding molecules targeting CD40 and FAP. CD80 expression was only slightly increased, however this increase was FAP-dependent and comparable to the CD80 upregulation induced by positive control antibody RO7009789 on the DCs (FIG. 7C and FIG. 7D). While CD86 expression was not significantly changed on DCs incubated with the different anti-CD40 antibodies compared to untreated DCs (FIG. 7G and FIG. 7H), CD70 expression was elevated due to the agonistic effects of these antibodies (FIG. 7A and FIG. 7B). Again both FAP-dependent antibodies only showed activating properties when FAP was present and their effects on CD70 were similar. However numbers of moDCs with upregulated CD70 expression was in a low range (maximum 8% of CD11c and CDIc positive cells). RO7009789 showed a higher potency to upregulate CD70 on DCs compared to the bispecific molecules in this experimental setting.

2.1.5 Activation of HEK-Blue™ CD40L Cells by FAP-Targeted Anti-Human CD40 Binding Molecules Using Murine FAP-Coated DYNABEADS® as Source of Antigen HEK-Blue™ CD40L cells (InvivoGen, Cat. No. hkb-cd40) were used as a reporter cell line to analyze human CD40 stimulation mediated by FAP-targeted anti-human CD40 binding molecules. HEK-Blue™ CD40L cells stably express the human CD40 receptor and NFκB-inducible secretion of embryonic alkaline phosphatase (SEAP). Binding of CD40L or agonistic anti-CD40 antibody to the CD40 receptor expressed on HEK-Blue™ CD40L cells triggers a signaling cascade leading to NFκB-mediated SEAP production. The amount of produced SEAP directly correlates with the extent of CD40 receptor activation. The levels of secreted SEAP in the supernatant can be measured with a spectrophotometer at 620-655 nm. $0.5 \times 10^5$ HEK-Blue™ CD40L cells in 160 µl pre-warmed HEK-Blue™ detection medium (InvivoGen. Cat. No. hb-det2) were seeded per well of a 96-well flat-bottom plate (TPP. Cat. No. 92696), Streptavidin DYNABEADS® were coated with biotinylated murine FAP and added in 20 µl PBS in a bead: cell ratio of 2:1 (as described in 2.1.3). As control non-coated beads were added to the reporter cells. FAP-targeted anti-human CD40 antibodies were added in 20 µl PBS to the cells at concentrations ranging from 6.89 nM to 0.0032 nM (3× dilution series). As control molecules antibodies tetravalent for human CD40 with one or two DP47 domains instead of a FAP binding domain and a FAP-independent cross-linked CD40 antibody (P1AD4470) were used. After 8 hours incubation at 37° C. SEAP levels in the supernatant were measured by a spectrophotometer at 650) nm.

For all agonistic FAP-targeted anti-human CD40 antibodies a pronounced and comparable SEAP production was observed. In the case of FAP-targeted bispecific antibodies mono- or bivalent for human CD40 SEAP production was detected only in the presence of FAP. In contrast, reporter cells treated with FAP-targeted bispecific antibodies tetravalent for human CD40 secreted SEAP independently of FAP availability. However, in the presence of FAP 25 higher SEAP levels were detected in supernatant of reporter cells treated with these antibodies. Moreover, the negative control antibodies tetravalent for human CD40 with one or two DP47 domains instead of a FAP binding domain induced comparable SEAP production in HEK-Blue™ CD40L cells in the presence and absence of FAP. The positive control antibody CD40 IgG (P1AD4470)+F (ab) induced similar levels of SEAP production as compared to FAP-targeted bispecific antibodies bivalent or tetravalent for human CD40 in the presence of FAP-coated beads (FIG. 8A. FIG. 8B, FIG. 19A and FIG. 19B). The $EC_{50}$ values as measured for the CD40 antibody as well as for different bispecific antibodies are shown in Table 11 below:

TABLE 11

| Activation of HEK-Blue ™ CD40L cells using murine FAP-coated DYNABEADS ® | | |
|---|---|---|
| Molecule | | $EC_{50}$ [nM] |
| P1AD4470 | CD40 IgG1 PGLALA | 0.125 |
| P1AE0637 | CD40 × FAP 4 + 1 with C-terminal crossFab | 0.031 |
| P1AD4453 | CD40 × FAP 4 + 1 | 0.067 |
| P1AD4574 | CD40 × DP47 4 + 1 | 0.421 |
| P1AD4455 | CD40 × FAP 4 + 2 | 0.077 |
| P1AA9641 | CD40 × FAP 2 + 1 | 0.197 |
| P1AE0408 | CD40 × FAP 2 + 1 head-to-tail | 0.167 |

TABLE 11-continued

| Activation of HEK-Blue ™ CD40L cells using murine FAP-coated DYNABEADS ® | | |
|---|---|---|
| Molecule | | $EC_{50}$ [nM] |
| P1AA9663 | CD40 × FAP 2 + 2 | 0.238 |
| P1AE0192 | CD40 × FAP 1 + 1 | 0.639 |
| P1AE0889 | CD40 (VH2a/VL2a) × FAP 4 + 1 with C-terminal crossFab | 0.044 |
| P1AE0890 | CD40 (VH2a/VL2a) × FAP 4 + 1 with C-terminal crossFab | 0.0005 |

2.2 CD40-Mediated Activation of DCs by FAP-Targeted Anti-CD40 Binding Molecules and Subsequent Priming of T Cells In order to demonstrate the ability of DCs activated by the FAP-dependent anti-human CD40 antibodies to efficiently prime T cells, in vitro T cell priming assays were established. For these assays DCs from the spleens of transgenic mice expressing the human CD40 receptor (huCD40tg mice) (mice with similar human and murine CD40 receptor expression pattern; C57BL/6 background; generated by Taconic) were isolated, pulsed with either SIINFEKL peptide or with ovalbumin (OVA) (DEC-205 receptor-mediated antigen uptake) and incubated with different agonistic anti-human CD40 antibodies. FAP was provided via FAP-coated DYNABEADS® in order to show FAP-dependency of the bispecific antigen binding molecules. 24 hours later CD8 positive T cells were isolated from spleens of OTI mice (CD8-positive T cells of these mice all possess a transgenic TCR recognizing SIINFEKL in the context of H2-Kb; C57BL/6-Tg (TcraTcrb) 1100Mjb/Crl, Charles River), carboxyfluorescein succinimidyl ester (CFSE) labelled and added to the pulsed DCs. On day five of the experiment s DC and T cell cytokines were analyzed in the supernatants of the cultured cells and T cells were analyzed for activation and proliferative capabilities.

2.2.1 T Cell Priming Via SIINFEKL-Pulsed DCs Activated by FAP-Targeted Anti-CD40 Binding Molecules DCs were isolated from the spleens of huCD40tg mice. In order to isolate splenic DCs, the spleen from a huCD40tg mouse was put into one well of a 6-well plate containing 2.25 mL Hank's Balanced Salt Solution (HBSS) with Calcium$^{2'}$ (Gibco. Cat. No. 14025-05). 250 µl of a mg/mL solution of collagenase D (end concentration 1 mg/mL) (Sigma-Aldrich. Cat. No. 11088866001) and 12.5 µl of a 10 mg/mL DNase solution (end concentration 0.05 mg/mL) (Sigma-Aldrich. D5025-150KU. Lot. No. SLBR0535V). Using a 3 ml syringe (BD. Cat. No. 309658) with a 21G needle (Braun. Cat. No. 4657527) the spleen was ballooned and subsequently, with the help of scissors, torn into small pieces. After a 25 minutes incubation at 37° C. 50 µL of 0.5 M ethylenediaminetetraacetic acid (EDTA) (Applichem. Cat. No. A4892.1000) were added, followed by a second incubation step at 37° C., for five minutes. The solution containing splenocytes and small pieces of splenic tissue was filtered through a 40 µm filter (Corning. Cat. No. 352340) into a 50 mL polypropylene centrifuge tube. Splenic tissue pieces were smashed through the filter with the end of a 3 ml syringe plug. In the next step the 50 mL tube was centrifuged at 1500 rpm for 5 minutes at room temperature, the supernatant was discarded and 1 mL of 1× cell lysis buffer (diluted 1:10 with distilled water) (BD. Cat. No. 555899) was added to the splenocytes in order to lyse the red blood cells. After four minutes of incubation at room temperature. 20 mL of R10 were added followed by a centrifugation step at 1500 rpm for 5 minutes at room temperature. The supernatant was removed, the splenocytes were resuspended in 30 mL of R10 and cell count as well as viability were determined with the automated EVE cell counter (VWR. Cat. No. 734-2675). The mouse CD11c UltraPure microbeads (Miltenyi. Cat. No. 130-108-338) were used according to the manufacturer's instruction to isolate DCs by AUTOMACS® separation. Subsequently $0.25 \times 10^5$ DCs were seeded in 50 µl of R10 per well of a 96-well flat-bottom plate. The DCs were then pulsed with SIINFEKL peptide (Ovalbumin residues 257-264) (Eurogentec. Cat. No. AS-60193-5. Lot. No. 1360618) in a suboptimal concentration of 1 pg/mL. This limited amount of antigen allows detecting variances in T cell activation due to differently activated DCs. As a positive control in order to induce high T cell activation independent of additional DC activating stimuli. SIINFEKL was added at a concentration of 1 ng/mL to the DCs. DCs that were not pulsed with the SIINFEKL antigen served as negative control. Human FAP-coated or non-coated DYNABEADS® were added in 50 µL of R10 to the DCs at a 2:1 bead: cell ratio. In the next step different agonistic anti-CD40 antibodies were added in 50 µL of R10 at concentrations ranging from 1 µg/mL to 1 ng/mL (10× dilution series). In this experimental setup, the bispecific anti-human CD40 antibody containing two FAP binding sites was compared to its equivalent with two DP47 domains instead of FAP binding domains, to the FAP-independent RO7009789 and cross-linked SGN-40 and to a murine FAP-dependent bispecific antibody tetravalent for murine CD40) and bivalent for FAP (28H1 FAP binder). After 24 hours splenic CD8-positive cells from OTI mice were isolated. In order to do so, the spleen of an OTI mouse was smashed through a 40 µm filter with the end of a 3 mL syringe plug into a 50 mL tube. The filter was washed with R10 and the splenocytes were centrifuged at 1500) rpm for 5 minutes at room temperature. 1 mL of 1× cell lysis buffer (diluted 1:10 with distilled water) was added to the cells and after four minutes of incubation at room temperature. 20 mL of R10 were added. The tube was centrifuged at 1500 rpm for 5 minutes at room temperature and the supernatant was discarded. The splenocytes were resuspended in 30 mL of R10) and cell counts as well as viability were determined with the automated EVE cell counter. CD8-positive cells were isolated in a negative selection process using the mouse CD8a' T Cell Isolation Kit (Miltenyi, Cat. No. 130-104-075) and AUTOMACS R' separation according to the manufacturer's instructions. CD8-positive cells that were found in the negative fraction after the separation were then washed with pre-warmed PBS, counted with the EVE cell counter and the cell number was adjusted to $2 \times 10^7$ cells/mL in pre-warmed PBS. 10 mM CFSE solution (CELLTRACE™ CFSE Cell Proliferation Kit.

ThermoFisher. Cat. No. C34554) was 5000-fold diluted in pre-warmed PBS and added to the cells resuspended in PBS in a 1:1 ratio (CFSE end concentration 1 µM). After a short vortex, cells were incubated for five minutes at room temperature. The labelling reaction was stopped by adding 40 mL of pre-warmed R10 medium to the cells. After two washing steps with PBS. CD8-positive cells were resuspended in R10 and $0.5 \times 10^5$ cells were added in 100 µl R10 to the pulsed DCs. On day five of the experiment T cells were restimulated for intracellular cytokine staining (ICS) with 0.5 µg/mL of SIINFEKL and 2 µg/mL anti-mouse CD28 antibody (eBioscience, clone 37.51. Cat. No. 16-0281-86). One hour after SIINFEKL and anti-CD28 addition. Brefeldin A (BFA) (BD. Cat. No. 51-2301KZ) (1:1000) was added to the cells in order to block intracellular protein transport. After another four hours incubation step. 150 µl of the supernatant were taken for LUMINEX™ based multiplexed cytokine measurement. In order to measure a set of 23 cytokines, the BIO-PLEX PRO™ Mouse Cytokine GrpI Panel 23-Plex kit (BioRad. Cat. No. M60009RDPD) was used according to the manufacturer's instructions. For flow cytometry analysis of the T cells, cells in the 96-well flat-bottom plates were transferred into 96-well round-bottom plates, washed once with PBS and incubated with 50 µl of 3 µg/mL of Fc receptor blocking Mouse IgG Isotype Control in PBS. After 15 minutes of incubation at 4° C., cells were washed with PBS and 50 µl of a mixture of fluorescently labelled antibodies in PBS was added to the cells. The following antibodies were used: anti-mouse CD86 BV785 (Biolegend, clone GL-1. Cat. No. 105043), anti-I-A/I-E PerCp-Cy5.5 (Biolegend, clone M5/114.15.2. Cat. No. 107626), anti-mouse CD70) PE (eBioscience, clone FR70), Cat. No. 12-0701-82), anti-mouse CD3 PE-CF594 (BD Biosciences, clone 145-2C11. Cat. No. 562286), anti-mouse CD25 PE-Cy7 (eBioscience, clone PC61.5. Cat. No. 25-0) 251-82), anti-mouse CD11c APC (BD Biosciences, clone HL3. Cat. No. 561119), anti-mouse CD44 Alexa Fluor 700 (BD Biosciences, clone IM7. Cat. No. 560567) and anti-mouse CD8 APC-Cy7 (Biolegend, clone 53-6.7. Cat. No. 100714). In order to distinguish between live and dead cells, the viability dye ZOMBIE AQUA™ was added to the antibody mixture. Cells were incubated for 30 minutes at 4° C., with the extracellular staining antibody solution. Afterwards cells were washed two times with PBS, permeabilized and intracellularly stained for IFNγ using anti-mouse IFNγ BV421 (Biolegend, clone XMG1.2. Cat. No. 505830) with the Foxp3/Transcription Factor Staining Buffer Set (eBioscience, Cat. No. 00-5523-00) according to the manufacturer's protocol. Cells were resuspended in 200 µl of PBS and analyzed the same day using a 5-laser LSR-Fortessa. Data analysis was performed using the FlowJo version 10 software. The population of live cells that displayed expression of CD8 and CD3 was analyzed for CFSE dye dilution. IFNγ production. CD44 and CD25 expression.

FIG. 9A, FIG. 9B, FIG. 9C, FIG. 9D, FIG. 9E, FIG. 9F, FIG. 9G, and FIG. 9H show that DCs pulsed with low amounts of SIINFEKL and stimulated with different agonistic anti-CD40 antibodies are able to induce T cell proliferation. In case of the FAP-dependent bispecific anti-CD40 antibodies proliferation is only induced when FAP is provided in the assay. Levels of proliferation induced by DCs stimulated with the murine or the human version of the bispecific antigen binding molecules with four CD40 and two FAP binding moieties was comparable. This strongly suggests that downstream signaling of the human CD40 receptor expressed on DCs is not impaired in the huCD40tg mice. No significant upregulation of the T cell activation markers CD44 and CD25 or IFNγ production was observed for T cells cocultured with DCs that have been stimulated with different agonistic anti-CD40 antibodies. Only DCs pulsed with high amounts of SIINFEKL displayed clear changes of these markers compared to the untreated condition.

Figure 9A:
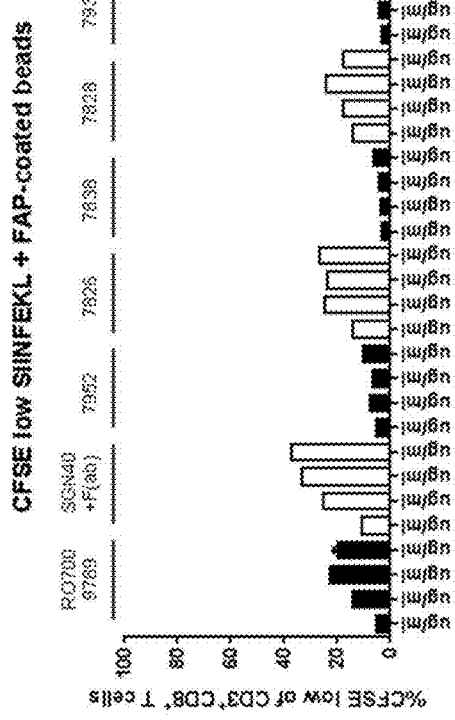
FIG. 9A, FIG. 9B, FIG. 9C, FIG. 9D, FIG. 9E, FIG. 9F, FIG. 9G, FIG. 9H show the T cell priming of SIINFEKL-pulsed DCs activated by FAP-targeted anti-CD40 binding molecules. DCs isolated from huCD40) transgenic mice (similar expression pattern of human CD40) and mouse CD40), pulsed with low amounts of SIINFEKL and stimulated with FAP-dependent bispecific anti-CD40 antibodies as well as FAP-coated beads induced a strong proliferation of antigen-specific T cells. In contrast, in the absence of FAP (uncoated beads) no T cell proliferation was induced by DCs stimulated with FAP-targeted anti-CD40) antibodies. T cell proliferation levels induced by DCs stimulated with the murine or the human bispecific antigen binding molecules with four CD40) and two FAP binding moieties was comparable. No significant upregulation of the T cell activation markers CD44 and CD25 or IFNγ production was observed for T cells co-cultured with DCs pre-stimulated with different agonistic anti-CD40) antibodies. Only DCs pulsed with high amounts of SIINFEKL induced a clear expression increase of these markers compared to the untreated condition. Shown is the percentage of proliferating (CFSE-low). IFNγ, CD25, and CD44 positive vital CFSE-labeled murine CD3$^+$ CD8$^+$ OT-1 T cells co-cultured with huCD40) tg DCs pre-incubated with the indicated titrated antibodies. The x-axis shows the concentration of antibody constructs.
Figure 9B:
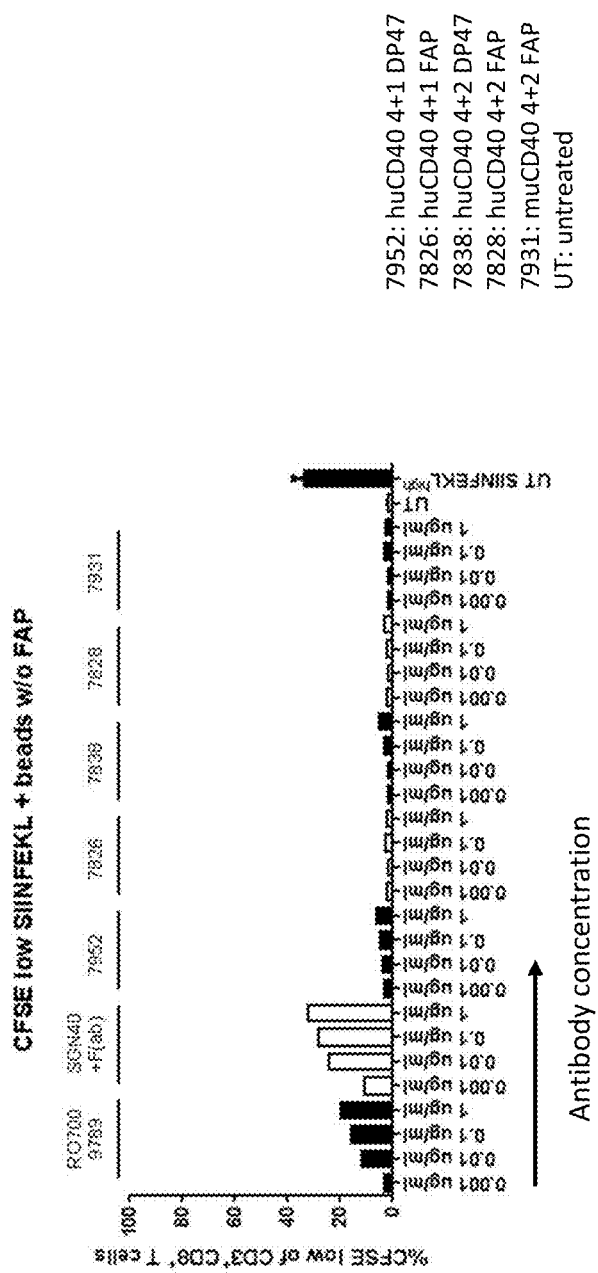
Figure 9C:
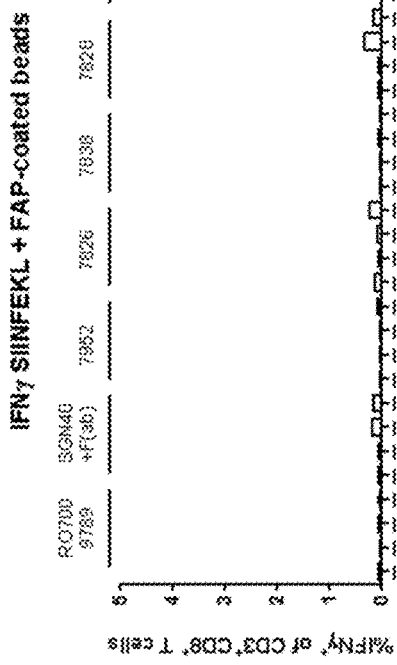
Figure 9D:
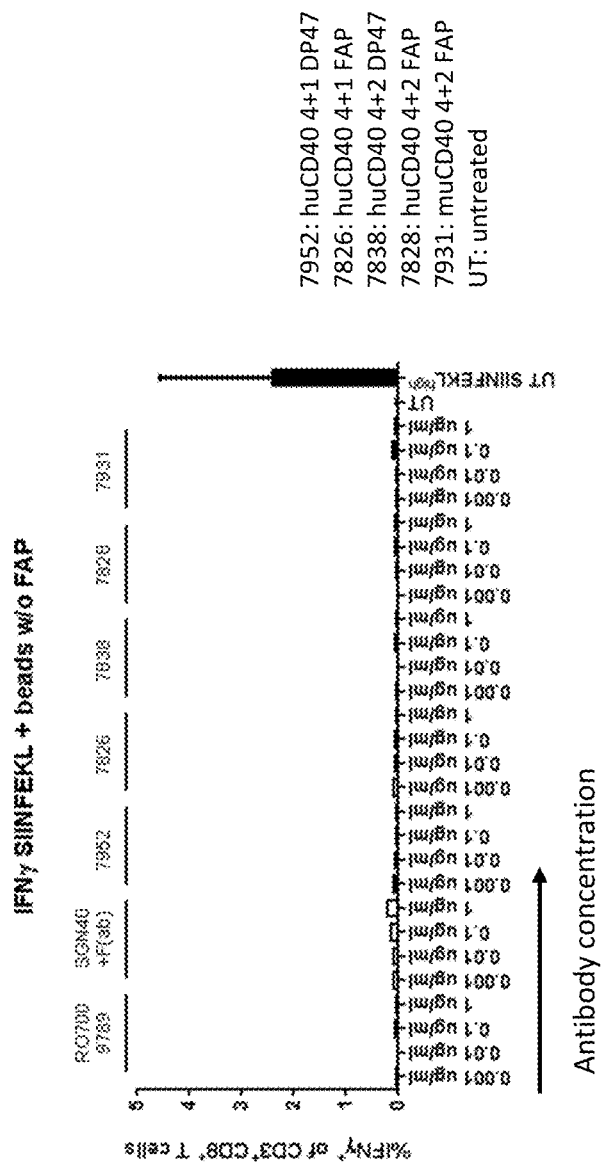
Figure 9E:
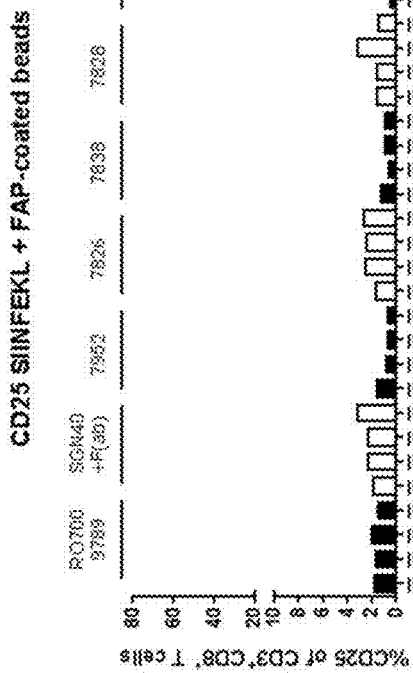
Figure 9F:
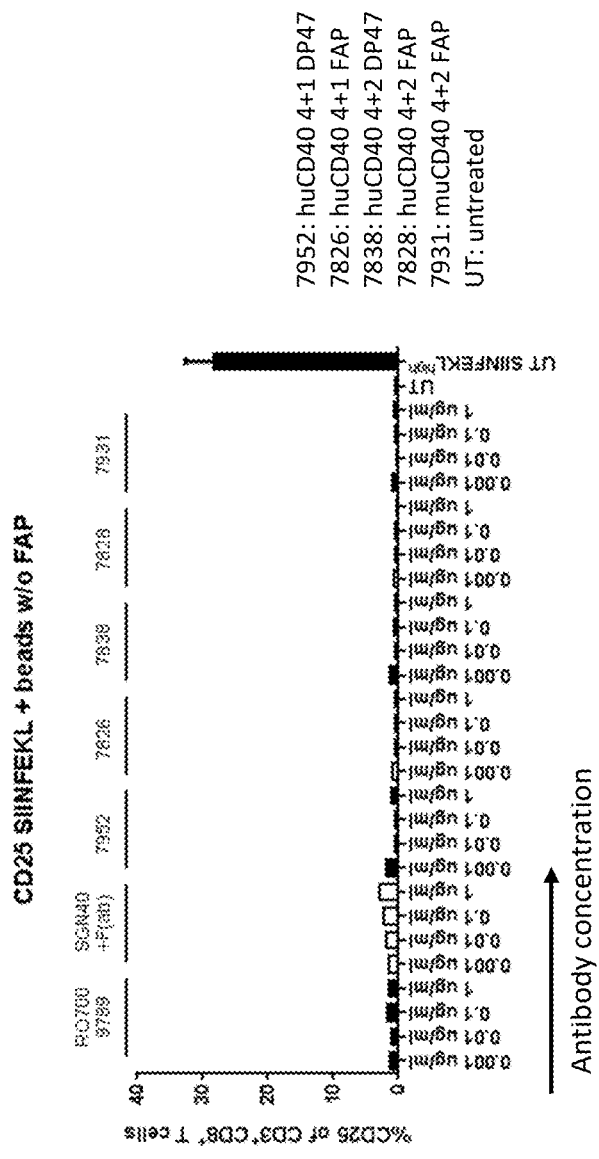
Figure 9G:
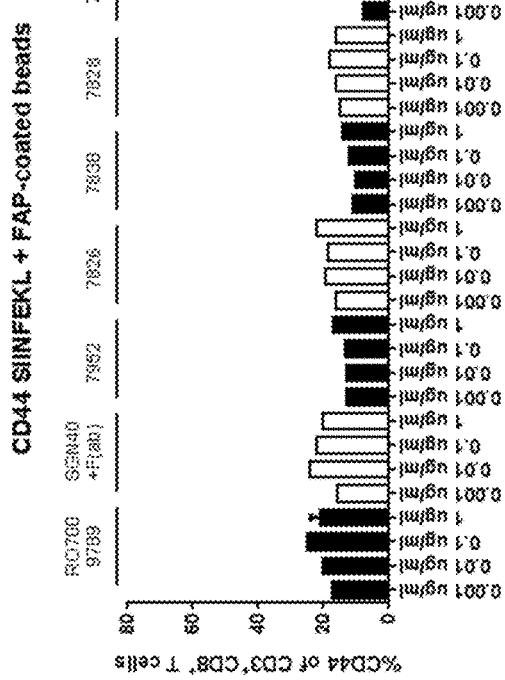
Figure 9H:
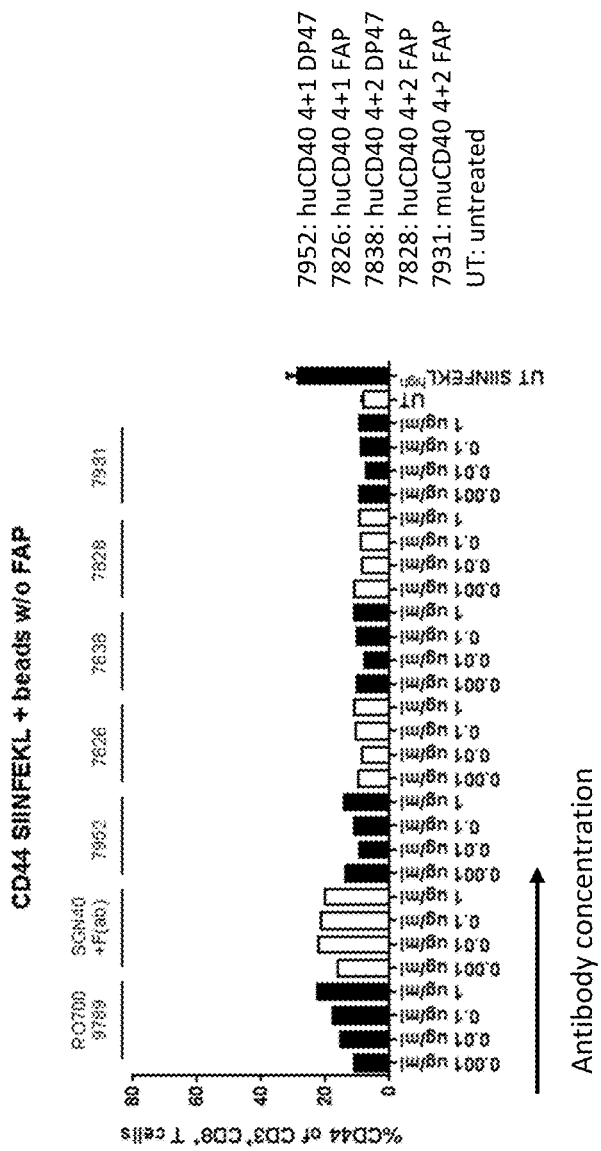
Figures 9I, 9J:
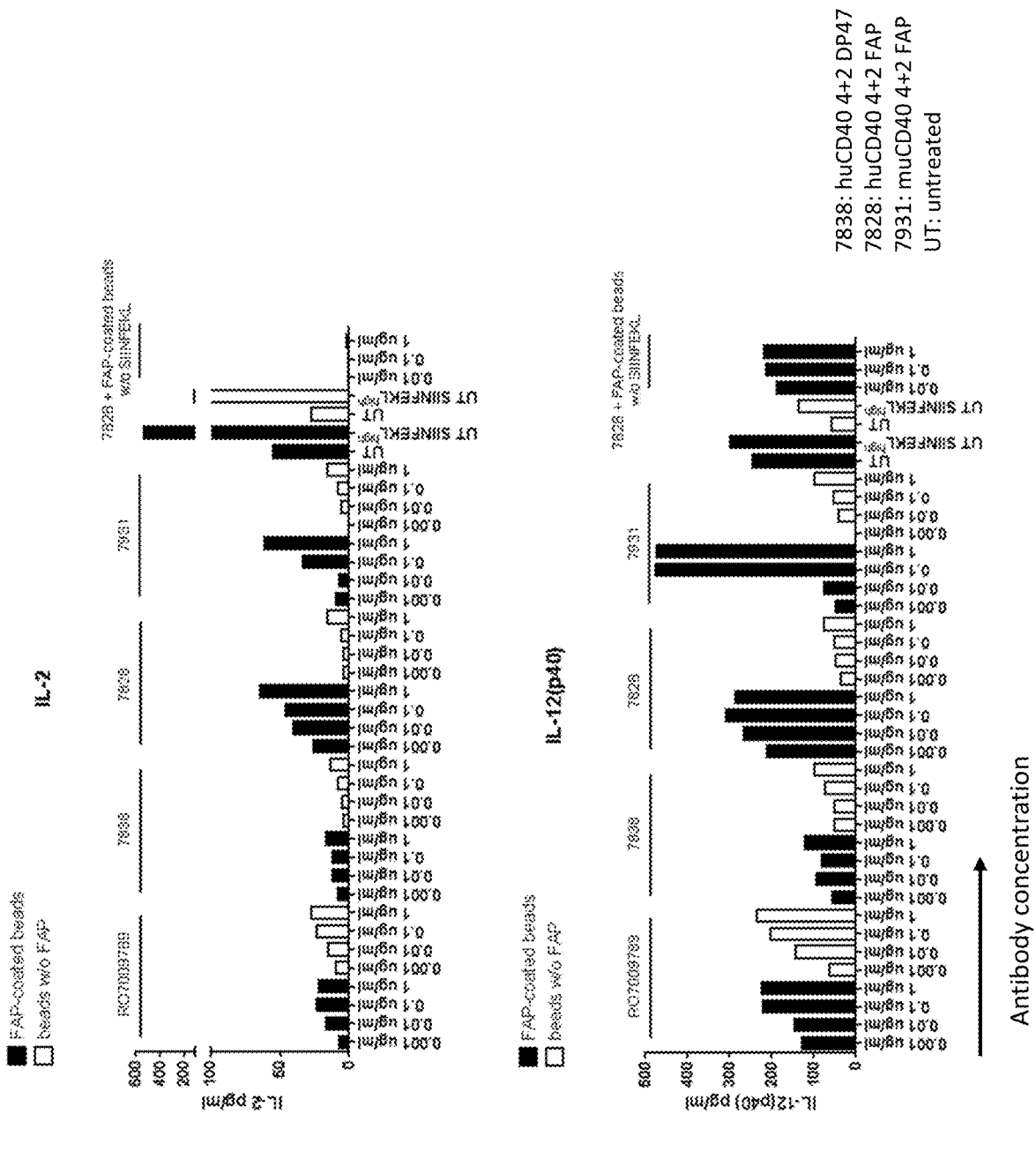
FIG. 9I and FIG. 9J show the concentration of IL-2 and IL-12 (p40) measured in the supernatant of T cell primed by SIINFEKL-pulsed FAP-targeted anti-CD40) antibody-activated DCs. In the co-culture of OT-1 T cells and huCD40 tg DCs pulsed with low amounts of SIINFEKL and stimulated with FAP-dependent bispecific anti-CD40) antibodies as well as FAP-coated beads increased IL-2 and IL-12 (p40)) levels were detected compared to OT-1 T cells co-cultured with huCD40) tg DCs pre-stimulated with FAP-targeted antibodies in the absence of FAP. Moreover, the murine bivalent FAP-targeted anti-CD40) antibody induced a markedly higher secretion of IL-12 (p40)) as the human equivalent bispecific antigen binding molecule. IL-2 secretion was increased to a similar extent with both, the anti-human CD40) and the anti-mouse CD40) bispecific antigen binding molecules in a FAP-dependent way. Shown is the IL-2 and IL-12 (p40) amount in the supernatant of murine CD3$^+$ CD8$^+$ OT-1 T cells co-cultured with huCD40) tg DCs pre-incubated with the indicated titrated antibodies measured by ELISA. The x-axis shows the concentration of antibody constructs.
Figure 10A:
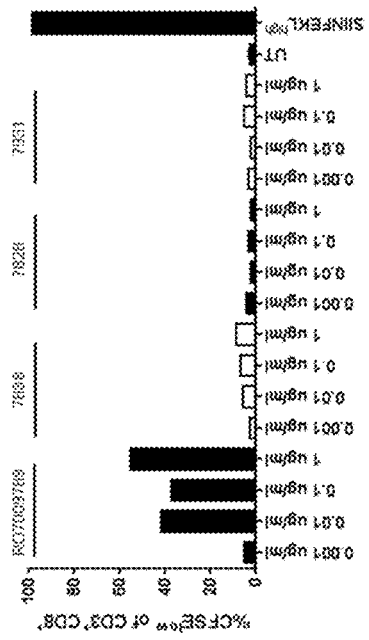
FIG. 10A, FIG. 10B, FIG. 10C, FIG. 11A, FIG. 11B, FIG. 11C, FIG. 12A, FIG. 12B, FIG. 12C show the T cell priming of OVA-pulsed DCs activated by FAP-targeted anti-CD40) binding molecules. DCs isolated from huCD40) transgenic mice, treated with DEC205-OVA conjugate and stimulated with FAP-dependent bispecific anti-CD40) antibodies as well as FAP-coated beads induced a strong proliferation and CD25 as well as CD44 expression of antigen-specific T cells. In contrast, in the absence of FAP (uncoated beads) or OVA (DEC only) no T cell proliferation and activation was induced by DCs stimulated with FAP-targeted anti-CD40) antibodies. T cell proliferation and CD25 as well as CD44 expression levels induced by DCs stimulated with the murine or the human bispecific antigen binding molecules with four CD40) and two FAP binding moieties was comparable. DCs pulsed with high amounts of SIINFEKL instead of DEC205-OVA conjugate also induced a strong T cell proliferation and expression of the activation markers CD25 and CD44. Shown is the percentage of proliferating (CFSE-low) (FIG. 10A, FIG. 10B, FIG. 10C). CD25 (FIG. 11A, FIG. 11B, FIG. 11C) and CD44 (FIG. 12A, FIG. 12B, FIG. 12C) positive vital CFSE-labeled murine CD3$^+$ CD8$^+$ OT-1 T cells co-cultured with huCD40 tg DCs pre-incubated with the indicated titrated antibodies in the presence or absence of OVA. The x-axis shows the concentration of antibody constructs.
Figure 10B:
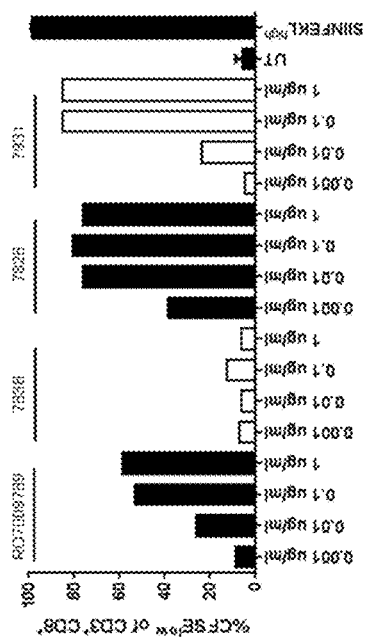
Figure 10C:
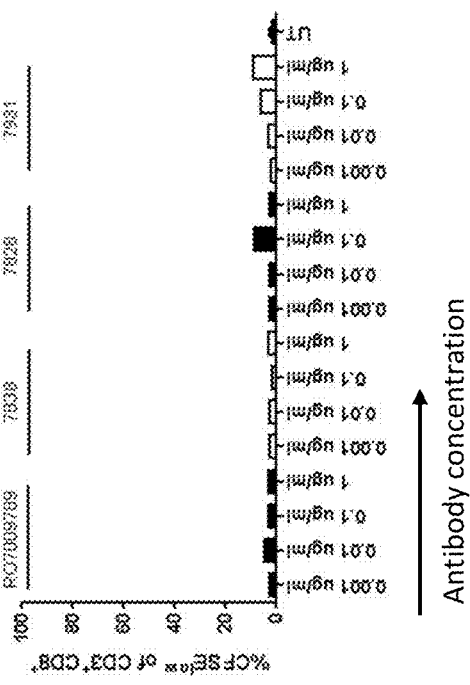
Figure 11A:
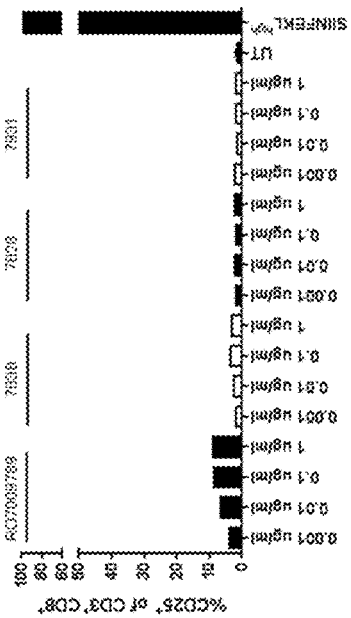
Figure 11C:
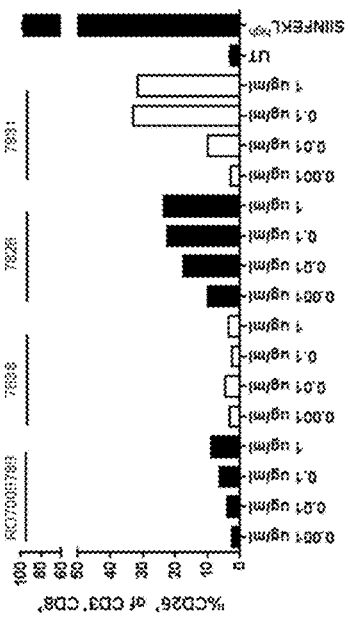
Figure 11B:
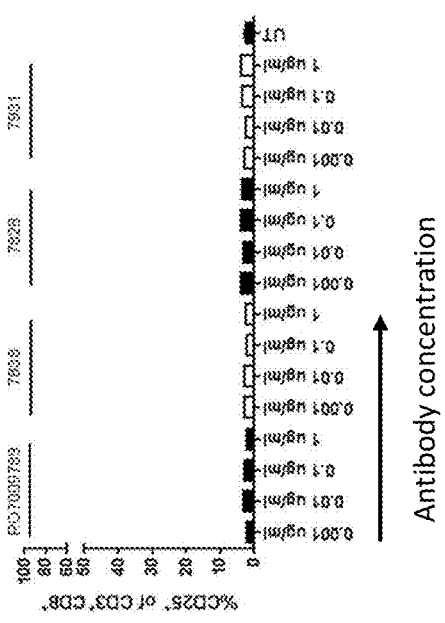

Cytokine concentration measurement in the supernatant showed an effect of the agonistic anti-CD40 antibodies on IL-2 (FIG. 9I) and IL-12 (p40) (FIG. 9J) expression. With the FAP-dependent human anti-CD40 antibody elevated IL-12 (p40) levels were detected only in the presence of FAP. However, the murine equivalent bispecific antigen binding molecule induced a markedly higher secretion of IL-12 (p40). IL-2 secretion was increased to a similar extent with both, the anti-human CD40 and the anti-mouse CD40 bispecific antigen binding molecules in a FAP-dependent way.

2.2.2 T Cell Priming Via OVA-Pulsed DCs Activated by FAP-Targeted Anti-CD40 Binding Molecules DCs were isolated from the spleens of huCD40tg mice and FAP-coated or non-coated DYNABEADS® as well as different agonistic anti-CD40 antibodies were added to the splenic DCs as described in section 2.2.1. Instead of pulsing DCs with SIINFEKL, which requires no uptake and processing by the DCs. OVA protein was used as antigen. In order to promote the OVA uptake in a Toll-like receptor (TLR) stimulus independent way (additional TLR stimuli might lead to a high overall activation of DCs, making the detection of different activation states due to stimulation with agonistic anti-CD40 antibodies impossible) the Ova Antigen Delivery Reagent (Miltenyi. Cat. No. 130-094-663) in combination with a biotinylated anti-mouse DEC205 antibody (Miltenyi, clone NLDC-145. Cat. No. 130-101-854) was used according to the manufacturer's protocol. In brief. DCs are incubated with a biotinylated antibody that binds to the DEC205 receptor, which is highly expressed on CD8-positive cross-presenting DCs (M. Lahoud et al., Int Immunol. 2000, 12 (5). 731-735). Afterwards the Ova delivery reagent, an anti-biotin antibody coupled to FITC and OVA, is added to the cells leading to DEC205 receptor-mediated uptake of OVA. In order to provide a negative control. DCs were only labelled with the anti-DEC205 antibody without the addition of OVA. On the next day. CD8-positive T cells were isolated from OTI mice. CFSE labelled and added to the DCs as described in section 2.2.1. On day five of the experiment 150 µl of supernatant were taken for IFNγ measurement using the Mouse IFN-gamma DUOSET® ELISA kit (R&D. Cat. No. DY485-05). The ELISA was performed as described in the protocol provided by the manufacturer. For FACS analysis of the T cells, cells in the 96-well flat-bottom plates were transferred into 96-well round-bottom plates, washed once with PBS and incubated with 50 µl of 3 µg/mL of Fc receptor blocking Mouse IgG Isotype Control in PBS. After 15 minutes of incubation at 4° C., cells were washed with PBS and 50 µl of a mixture of fluorescently labelled antibodies in PBS were added to the cells. The following antibodies were used: anti-mouse CD4 BV421 (Biolegend, clone GK1.5. Cat. No. 100438), anti-mouse CD86 BV785 (Biolegend, clone GL-1. Cat. No. 105043), anti-I-A/I-E PerCp-Cy5.5 (Biolegend, clone M5/114.15.2. Cat. No. 107626), anti-mouse CD70) PE (eBioscience, clone FR70), Cat. No. 12-0701-82), anti-mouse CD3 PE-CF594 (BD Biosciences, clone 145-2C11. Cat. No. 562286), anti-mouse CD25 PE-Cy7 (eBioscience, clone PC61.5. Cat. No. 25-0251-82), anti-mouse CD11c APC (BD Biosciences, clone HL3. Cat. No. 561119), anti-mouse CD44 Alexa Fluor 700 (BD Biosciences, clone IM7. Cat. No. 560567) and anti-mouse CD8 APC-Cy7 (Biolegend, clone 53-6.7. Cat. No. 100714). In order to distinguish between live and dead cells, the viability dye ZOMBIE AQUA™ was added to the antibody mixture. Cells were incubated for 30 minutes at 4° C., with 50 µl of the staining antibody mix. Afterwards cells were washed two times with PBS, resuspended in 200 µl of PBS and analyzed using 5-laser 30) LSR-Fortessa. Data analysis was performed using the FlowJo version 10 software. Viable CD3- and CD8-positive cells were analyzed for CFSE signal. CD25 and CD44 expression.

Figure 12A:
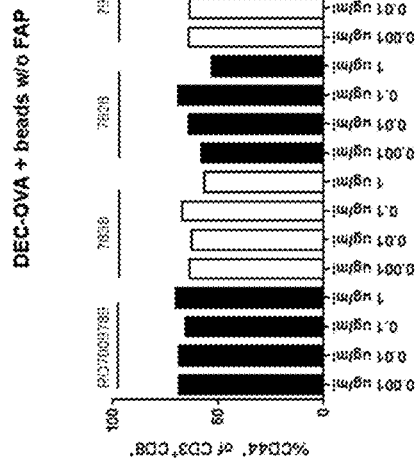
Figure 12C:
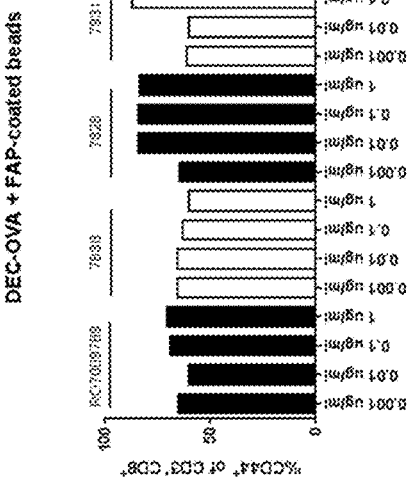
Figure 12B:
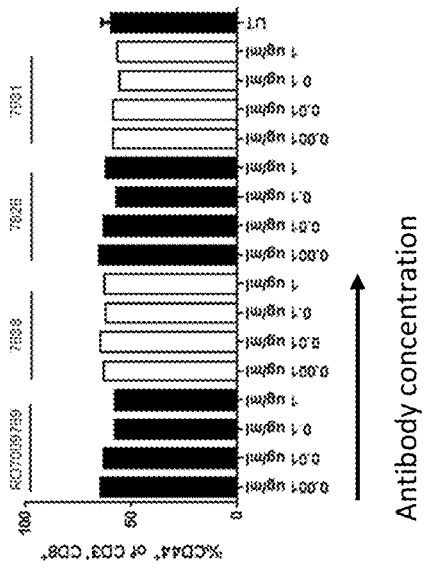
Figure 13B:
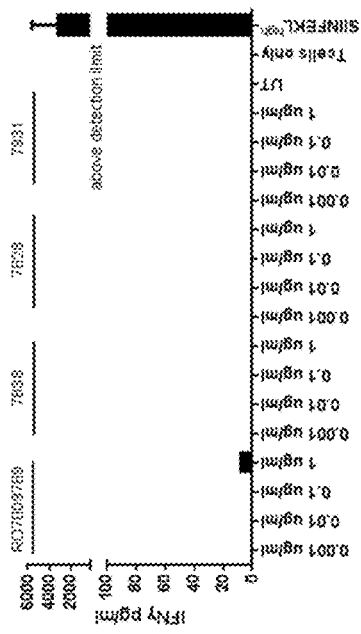
FIG. 13A, FIG. 13B, FIG. 13C show IFNγ levels measured in the supernatants of T cells co-cultured with OVA-pulsed DCs activated by FAP-targeted anti-CD40) binding molecules. IFNγ levels were elevated in conditions with T cells co-cultured with DCs treated with the anti-human CD40 FAP-targeting antibody in the presence of FAP (FIG. 13A). In addition. IFNγ secretion was increased to a similar extent with both, the anti-human CD40) and the anti-mouse CD40 bispecific antigen binding molecules in a FAP-dependent way. Shown is the IFNγ amount in the supernatant of murine CD3$^+$ CD8$^+$ OT-1 T cells co-cultured with huCD40 tg DCs pre-incubated with the indicated titrated antibodies measured by ELISA. The x-axis shows the concentration of antibody constructs.
Figure 13A:
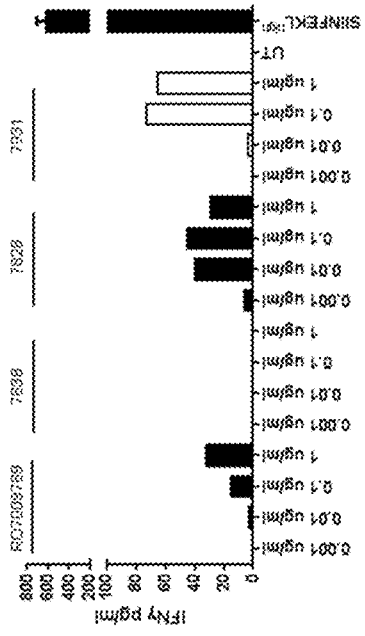
Figure 13C:
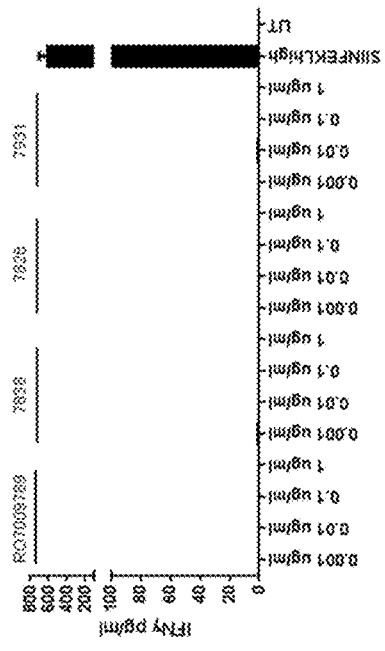

FIG. 10A, FIG. 10B, FIG. 10C, FIG. 11A, FIG. 11B, FIG. 11C. FIG. 12A, FIG. 12B, FIG. 12C and FIG. 22A and FIG. 22B show that DCs incubated with the OVA delivery reagent and stimulated with the bispecific antigen binding molecule targeting human CD40) and FAP can significantly enhance CD8 positive OTI T cell proliferation (FIG. 10A, FIG. 10B to FIG. 10C and FIG. 22A, FIG. 22B) as well as expression of the T cell activation markers CD25 (FIG. 11A, FIG. 11B, FIG. 11C) and CD44 (FIG. 12A, FIG. 12B, FIG. 12C). These effects were FAP-dependent. The results of the IFNγ ELISA confirm the enhanced T cell activation due to the human anti-CD40) FAP-targeted antibody: IFNγ levels were elevated in conditions with T cells cocultured with DCs treated with the anti-human CD40 FAP targeting antibody (FIG. 13A, FIG. 13B, FIG. 13C). Effects of the murine anti-CD40 FAP-targeted antibody were comparable, underpinning the hypothesis that the huCD40tg mouse model provides a suitable system for measuring the effects of agonistic anti-human CD40) antibodies.

Example 3

Functional Properties of FAP-Targeted Anti-Murine CD40 Binding Molecules 3.1 CD40-Mediated In Vitro Activation of Murine B Cells by FAP-Targeted Anti-Murine CD40 Binding Molecules Spleens from C57BL/6J mice were processed as described in section 2.2.1. Murine B cells were isolated from splenocytes using the mouse B cell isolation kit (Miltenyi, Cat. No. 130-090-862) according to the manufacturer's instructions. $1 \times 10^5$ B cells were seeded in 100 µl R10 per well of a 96-well flat-bottom plate. DYNABEADS® coated with murine biotinylated FAP (in-house production) (see 2.1.3 for detailed description) or non-coated DYNABEADS® as control were added in 50 µl R10 in a bead: cell ratio of 2:1. Agonistic anti-murine CD40) antibodies were added in 50 µl of R10 to the B cells. Antibody concentrations varied from 1 µg/mL to 0.3 ng/ml (3× dilution series). In this experimental setup bispecific antigen binding molecules carrying four anti-mouse CD40) binding sites and either one or two FAP binding sites (28H1 FAP binder, equivalent to the FAP binding domain in anti-human CD40 bispecific antigen binding molecules) were compared to the FAP-independent FGK4.5 antibody (rat IgG2a. Bio X Cell Catalogue No. BE0016-2), which is bivalent for murine CD40. The biological activity of FGK4.5 is dependent on Fc receptor cross-linking (L. Richman et al., *Cancer Immunol Res.* 2014, 2 (1)), therefore FGK4.5 was pre-incubated for 30 minutes at room temperature with a goat anti-rat IgG (H+L) cross-linking antibody (Jackson ImmunoResearch, Cat. No. 112-005-003. Lot. No. 123801). After 48 hours B cells were analyzed for expression of activation markers by FACS. For this purpose. B cells were transferred into 96-well flat-bottom plates, washed with PBS and incubated with 50 µl of 3 µg/mL of Fc receptor blocking Mouse IgG Isotype Control in PBS. After 15 minutes of incubation at 4° C., cells were washed with PBS and 50 µl of a mixture of fluorescently labelled antibodies in PBS was added to the cells. The following antibodies were used: anti-mouse CD19 BV605 (BD Biosciences, clone 1D3. Cat. No. 563148), anti-mouse CD86 BV785 (Biolegend, clone GL-1. Cat. No. 105043), anti-I-A/I-E PerCp-Cy5.5 (Biolegend, clone M5/114.15.2. Cat. No. 107626), anti-mouse CD70) PE (eBioscience, clone FR70), Cat. No.

12-0) 701-82), anti-mouse CD80) PE-CF594 (BD Biosciences, clone 16-10A1. Cat. No. 562504), anti-mouse CD3 PE-Cy7 (BD Biosciences, clone 145-2C11. Cat. No. 552774), anti-mouse NK1.1 PE-Cy7 (Biolegend, clone PK136. Cat. No. 108714), anti-mouse CD11c APC (BD Biosciences, clone HL3. Cat. No. 561119), anti-mouse CD45 Alexa Fluor 700) (eBioscience, clone 30-F11. Cat. No. 56-0451-82), anti-mouse CD8 APC-Cy7 (Biolegend, clone 53-6.7. Cat. No. 100714). To distinguish between live and dead cells, the viability dye ZOMBIE AQUA™ was added to the antibody mixture. Cells were incubated for 30 minutes at 4° C., with the staining mixture, washed two times with PBS and then resuspended in 200 μl of PBS. FACS analysis was performed with a 5-laser LSR-Fortessa and data analysis was conducted using the FlowJo version 10 software. Viable, single cells were gated for CDIIc-negative. CD3-negative and NK1.1-negative cells in order to exclude non-B cells. CD8-negative. CD19-positive cells were analyzed for expression of the B cell activation markers CD70, CD80. CD83 and CD86.

Figures 14A, 14B:
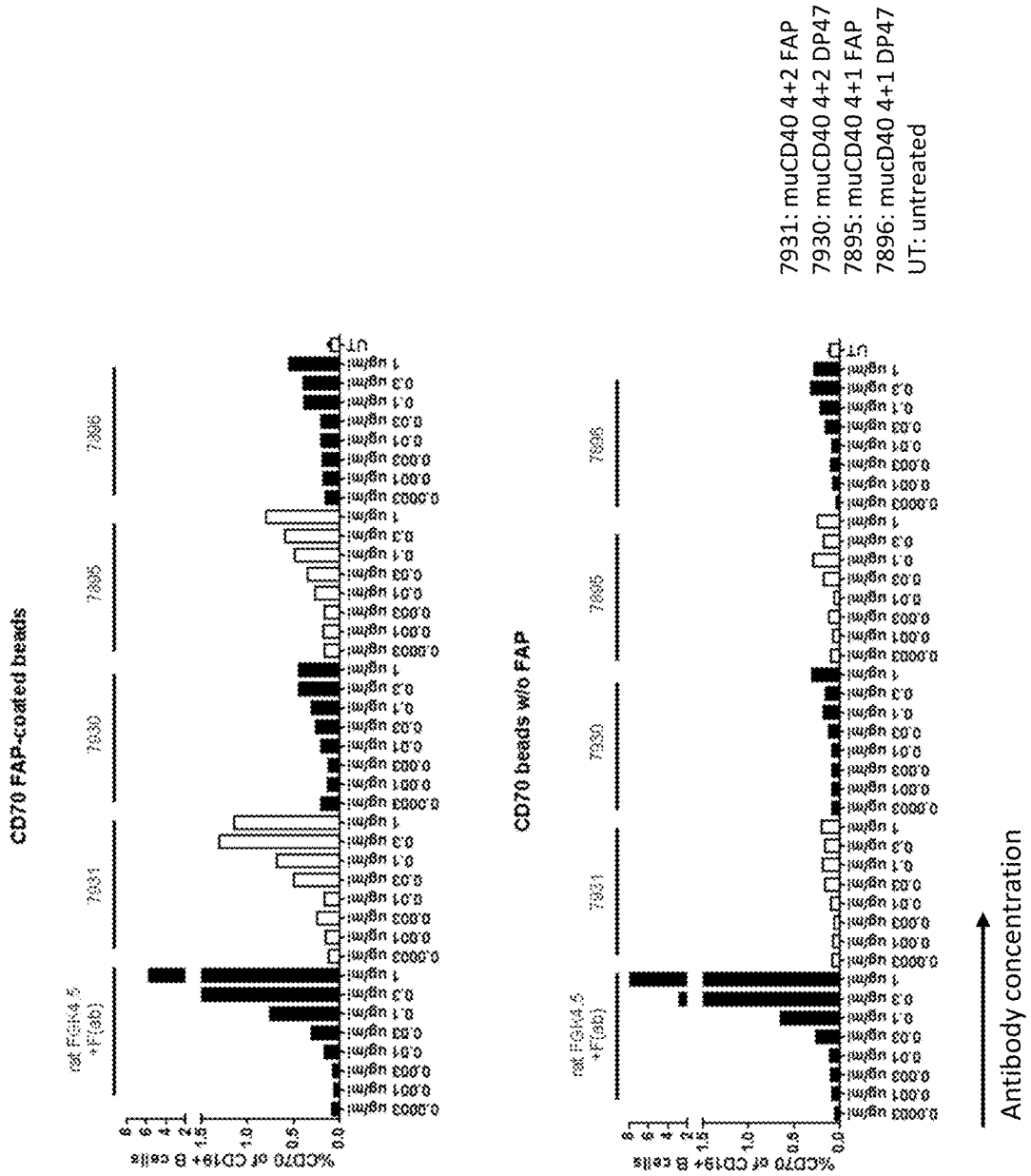
FIG. 14A, FIG. 14B, FIG. 14C, FIG. 14D, FIG. 14E, FIG. 14F, FIG. 14G, FIG. 14H show the in vitro activation of murine B cells by mono- or bivalent FAP-targeted mouse anti-CD40) constructs in the presence of FAP-coated or uncoated DYNABEADS® after 2 days incubation. With FAP-coated beads the bispecific antibody monovalent for FAP induced a similar increase of B cell activation marker expression (CD70, CD80, and CD86) as the bivalent FAP-targeted molecule. Moreover, a significant B cell activation marker upregulation was also observed for B cells treated with the FAP-independent positive control antibody FGK4.5. In the absence of FAP (uncoated beads) no increase of the B cell activation markers CD70 and CD80 could be observed with the bispecific antigen binding molecules. In contrast, the positive control antibody induced an upregulation of CD70 and CD80 irrespective of FAP pre-treatment. While CD86 upregulation was FAP-dependent with the tetravalent anti-mouse CD40 antibody possessing two FAP binding moieties, a FAP-independent effect was observed for the bispecific antigen binding molecule having only one FAP binding site. In addition, a FAP-independent upregulation of MHC-II expression was observed for all tested bispecific antigen binding molecules. Shown is the percentage of CD70) (FIG. 14A and FIG. 14B), CD80) (FIG. 14C and FIG. 14D), CD86 (FIG. 14E and FIG. 14F) and MHCII (FIG. 14G and FIG. 14H) positive vital B cells after 2 days incubation with the indicated titrated antibodies. The x-axis shows the concentration of antibody constructs.
Figures 14C, 14D:
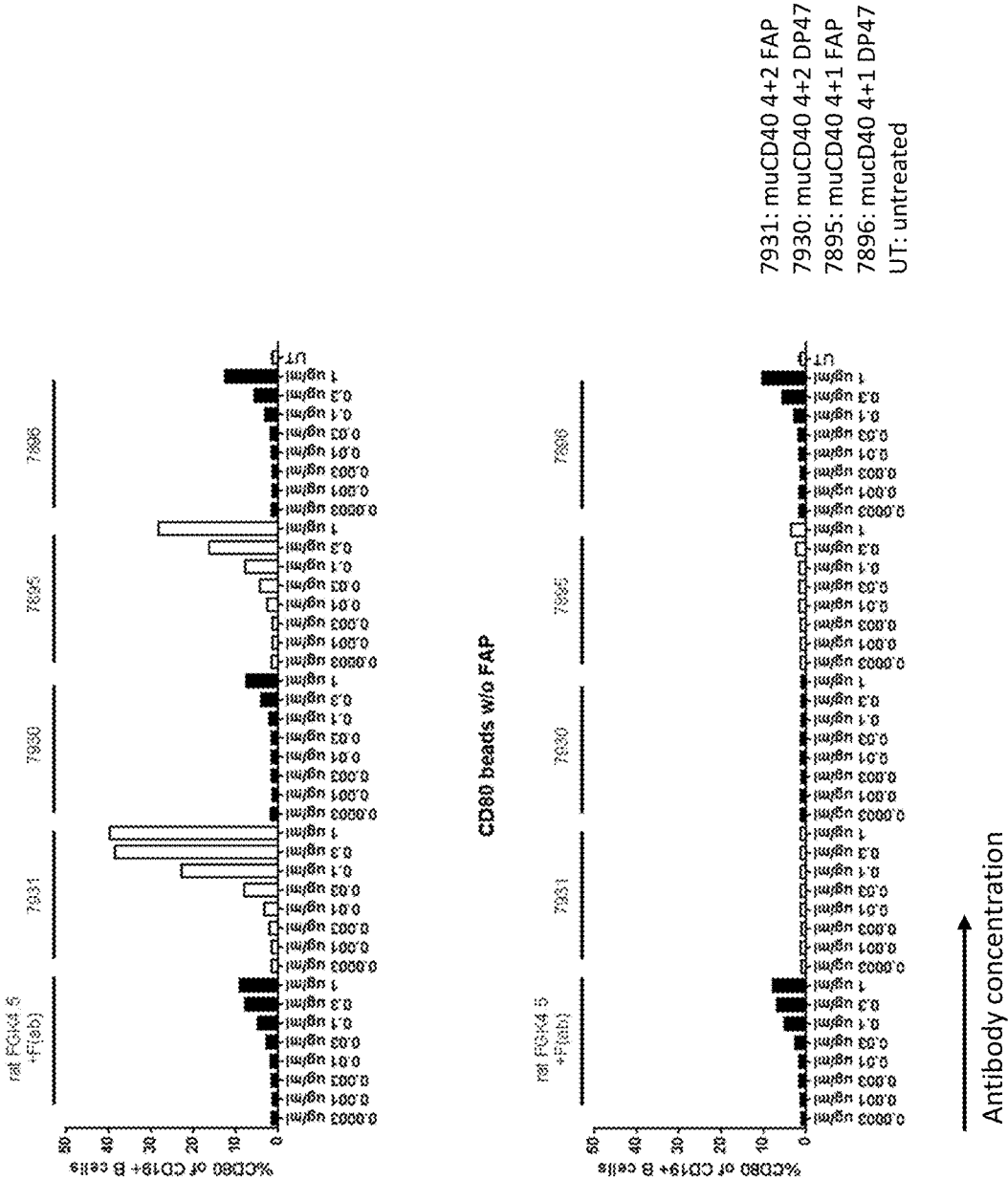

Incubation of murine B cells with the FAP-targeted anti-mouse CD40) antibodies with either one or two FAP binding moieties increased expression of B cell activation markers. CD70) expression was only slightly increased with the bispecific antigen binding molecules compared to conditions with the cross-linked FGK4.5 antibody (FIG. 14A and FIG. 14B). However, overall numbers of cells expressing high levels of CD70 were rather low. CD80 expression was upregulated in a FAP-dependent manner upon treatment of B cells with the bispecific molecules targeting murine CD40) and FAP (FIG. 14C and FIG. 14D). Bispecific molecules showed higher potency than the bivalent FAP-independent FGK4.5 antibody in case of CD80 upregulation.

Figures 14E, 14F:
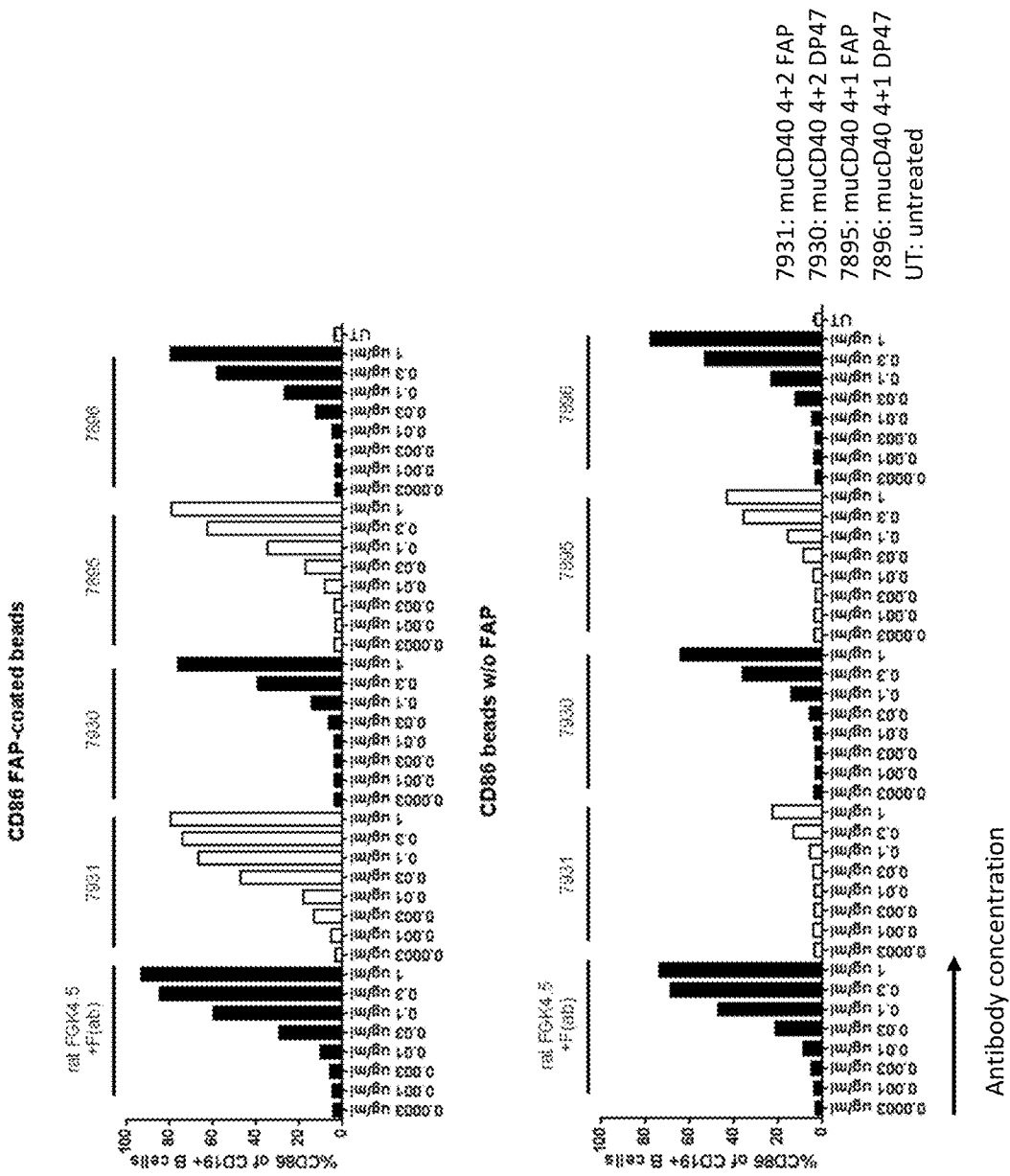
Figures 14G, 14H:
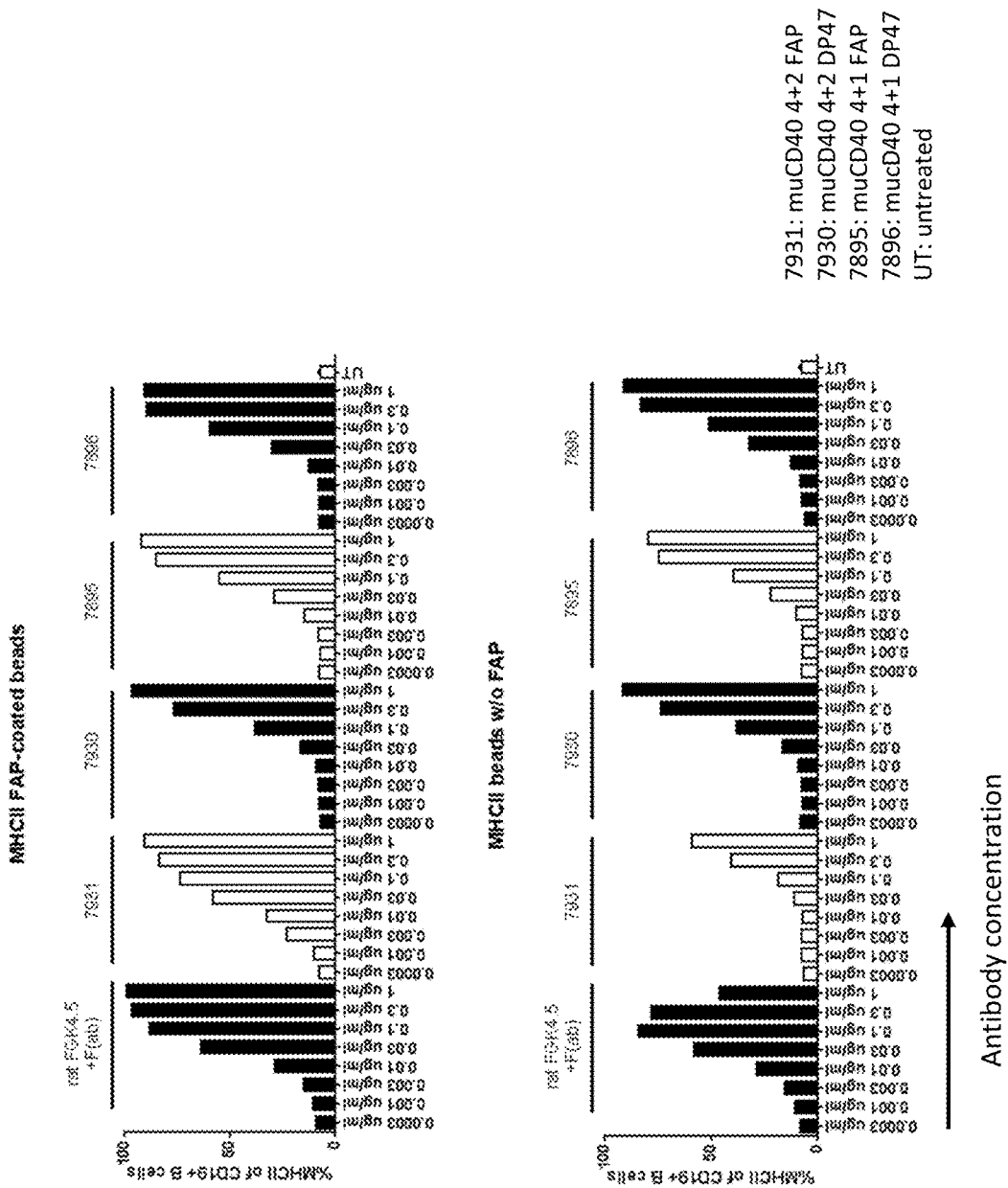
Figure 16B:
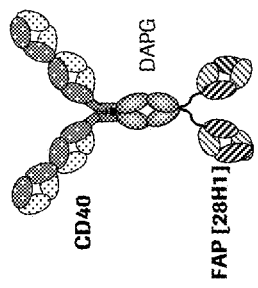
FIG. 16B, FIG. 16C, FIG. 16D, FIG. 16E show schematic representations of the bispecific antigen binding molecules which specifically bind to mouse CD40) and to FAP or DP47.
Figure 16C:
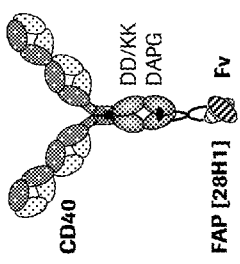
Figure 16D:
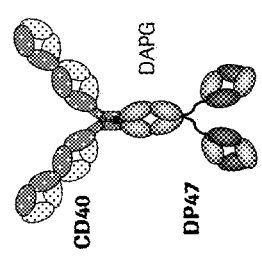
Figure 16E:
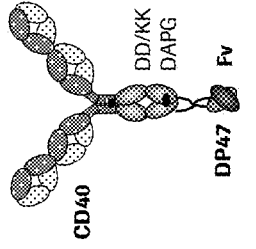
Figure 16A:
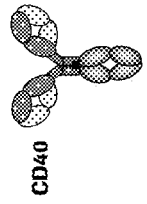
FIG. 16A shows the parental murine FGK4.5 antibody (P1AD3449).

20) CD86 expression increase was as well induced by all agonistic anti-CD40 antibodies tested and expression levels were comparable for all antibodies (FIG. 14E and FIG. 14F). While CD86 upregulation was FAP-dependent with the tetravalent anti-mouse CD40) antibody possessing two FAP binding moieties, a FAP-independent effect was observed for the bispecific antigen binding molecule having only one FAP binding site. In addition, a FAP-independent upregulation of MHC-II expression was observed for all tested bispecific antigen binding molecules (FIG. 14G and FIG. 14H)

3.2 CD40-Mediated In Vivo Activation of Murine DCs and T Cells by FAP-Targeted Anti-Murine CD40 Binding Molecules The murine colon adenocarcinoma MC38_FAP transfectant tumor cell line with mouse FAP expression was obtained from an in-vivo-passage performed at Roche Glycart AG and after expansion deposited in the Roche Glycart internal cell bank. MC38_muFAP_invipa cells were cultured in DMEM containing 10% FCS (PAA Laboratories. Austria), ImM Pyruvate, 1× NEAA and 6 μg/ml Puromycine. Cells were cultured at 37° C., in a water-saturated atmosphere at 5% $CO_2$ and were injected at in vitro passage 14 at a viability of 95%. 2×106 tumor cells were injected subcutaneously in a 100 μl cell suspension (50% RPMI medium and 50% MATRIGEL™). 33 C57BI/6 female mice with an age of 8-9 weeks at start of the experiment (purchased from Charles Rivers. Germany) were maintained under specific-pathogen-free condition with daily cycles of 12 h light and 12 h darkness according to committed guidelines (GV-Solas; Felasa; TierschG). Experimental study protocol was reviewed and approved by local government (P 2011-128) and after arrival animals were maintained for one week to get accustomed to the new environment and for observation. They were afterwards implanted with a transponder subcutaneously on the right side of the back for identification and maintained one more week for recovery. Continuous health monitoring was carried out on regular basis. To study the FAP-targeted activation of CD40 in vivo mice were injected subcutaneously on study day 0) with 2×106 of MC38-FAP. At day x when tumors reached 200 $mm^3$, 9 mice per group were injected i.p, with 200 μL of the different compounds. Mice in the vehicle group were injected with Histidine buffer and animals in the treatment groups were either injected with 10 mg/kg FGK4.5 or 15 mg/kg FGK4.5 4+1. Animals were controlled daily for clinical symptoms and detection of adverse effects such as weight loss. Termination criteria for animals were clinical sickness, impaired locomotion and scruffy fur. At the time points 72h and 8d post therapy injection, tumor, spleen, tumor-draining and tumor-non-draining lymph nodes were collected from three mice per group and analyzed by flow cytometry. In addition, serum from all sacrificed animals was collected to analyze serum enzymes indicative of liver injury.

For flow cytometer analysis single cell suspensions of all collected organs were prepared and stained with fluorescently labelled antibodies as described in section 2.1.1, and section 3.1, respectively. To distinguish between live and dead cells, the viability dye ZOMBIE AQUA™ was added to the antibody mixture. Cells were incubated for 30 minutes at 4° C., with the staining mixture, washed two times with PBS and resuspended in 200 μl of PBS. FACS analysis was performed with a 5-laser LSR-Fortessa and data analysis was conducted using the FlowJo version 10 software. DCs were identified as viable, single cells highly positive for CDIIc and MHC class II and negative for CD3. NK1, 1 and CD19. CD70 and CD86 expression, both DC activation markers, was analyzed on DCs three days post therapy injection. Viable CD45–. CD3- and CD8-positive single cells were identified as $CD8^+$ T cells. $CD8^+$ T cells were analyzed for Ki67 FITC (eBioscience, clone SolA15. Cat. No. 11-5698-82) expression and total numbers of $CD8^+$ T cell in the tumors were determined using absolute cell count beads (Invitrogen. Cat. No. 01-1234).

Figure 23A:
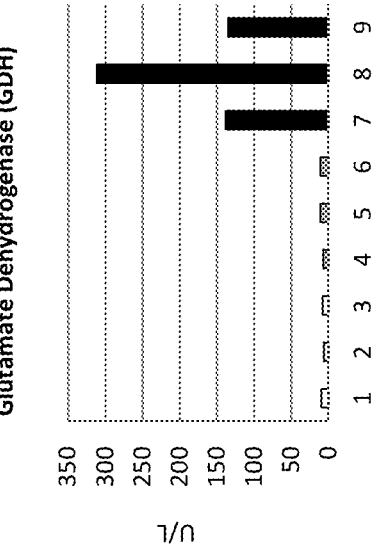
Figure 23B:
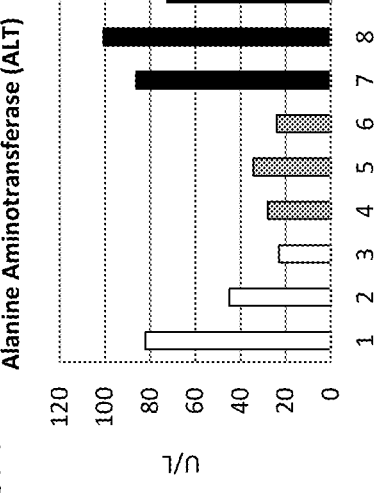
Figure 23C:
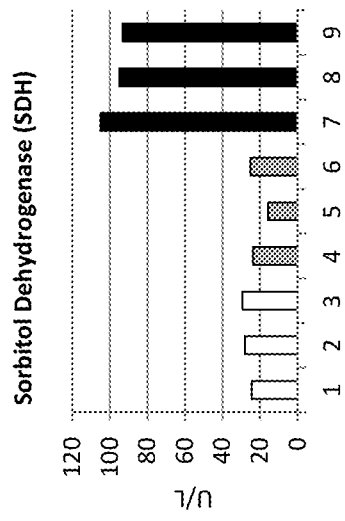
Figure 23E:
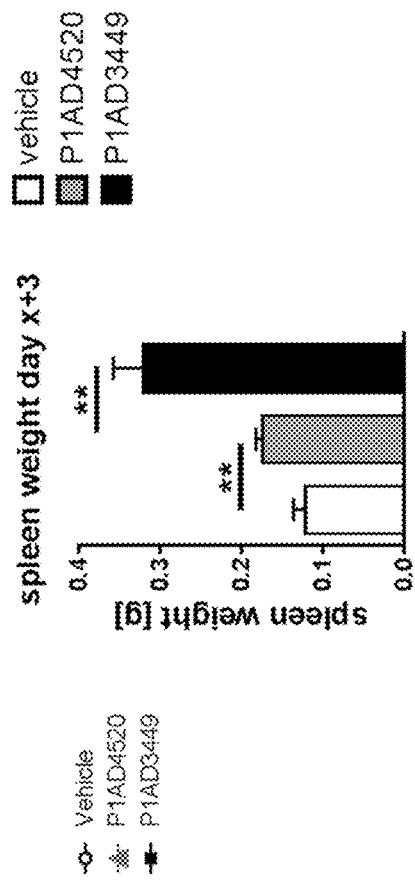
Figure 23D:
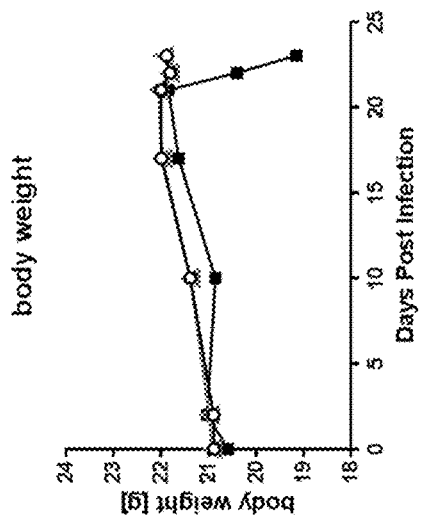
Figure 25A:
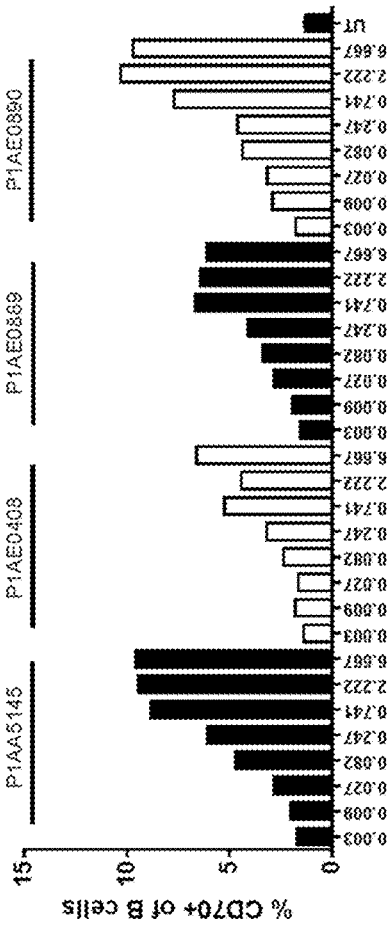
FIG. 25A and FIG. 25B show the in vitro activation of human B cells by bivalent FAP-targeted human anti-CD40 constructs in the presence of FAP-coated (FIG. 25A and FIG. 25C) or uncoated DYNABEADS® (FIG. 25B and FIG. 25D) after 2 days incubation. Compared to the FAP-independent upregulation of CD70) and CD86 induced by the cross-linked CD40) antibody (PIAA5145), CD70) upregulation (FIG. 25A) and CD86 upregulation (FIG. 25C) induced by FAP-dependent bispecific antigen binding molecules was slightly lower. In the absence of FAP (uncoated beads) no increase of CD70) (FIG. 25B) or CD86 expression (FIG. 25D) could be observed with the bispecific antigen binding molecules, while positive control antibodies induced an upregulation of activation markers. Shown is the percentage of CD70 or CD86 positive vital B cells after 2 days incubation with the indicated titrated antibodies. The x-axis shows the concentration of antibody constructs.
Figure 25B:
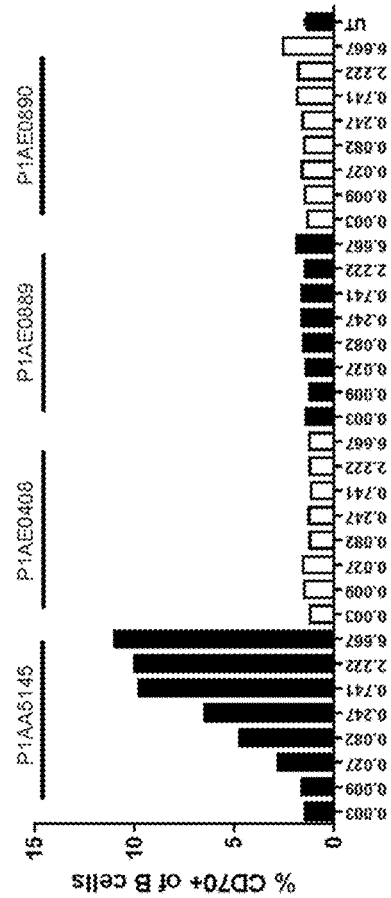
Figures 25C, 25D:
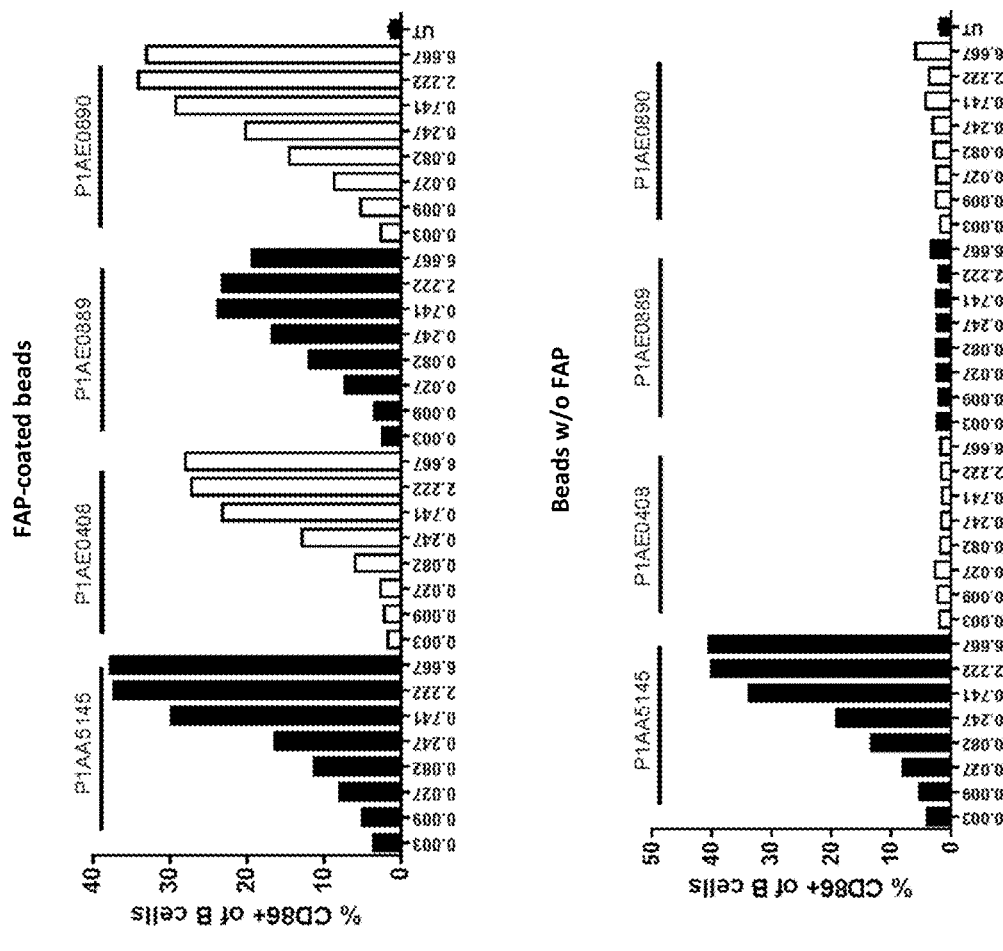

As shown in FIG. 23A, FIG. 23B, and FIG. 23C, on day 3 enzymes suggestive of hepatocellular injury were increased in mice injected with a single i.p, dose of CD40 but not in mice injected FAP-CD40 or vehicle alone. In addition, the body weight was deceased and the spleen weight was increased of CD40-treated mice three days post treatment compared to mice injected with FAP-CD40 4+1 or vehicle alone (FIG. 23D and FIG. 23E, respectively) indicating less severe side effects in animals treated with the FAP-targeted CD40 antibodies compared to animals treated with the parental CD40 antibody. Although to a lesser extent than FGK4.5. FAP-targeted anti-CD40 antibodies induced a significant increase in DC activation (CD86 and CD70 expression) in tumor-draining lymph nodes three days post treatment (FIG. 24A and FIG. 24B) and $CD8^+$ T cell proliferation (Ki68 expression and cell numbers) in tumors eight days post treatment (FIG. 24C and FIG. 24D) compared to vehicle-treated mice. In summary, the FAP-targeted anti-CD40 molecule with FAP-dependent activation of CD40 in a 4+1 format induces potent DC and T cell activation in tumor-bearing mice with reduced systemic toxicity compared to the untargeted anti-CD40 parental antibody FGK4.5.

Example 4

Generation and Production of Humanized Variants of Anti-CD40 Antibody S2C6

4.1 First Generation of Humanized Variants of Anti-CD40 Antibody S2C6

4.1.1 Methodology

Anti-CD40 antibody S2C6 is disclosed in WO 2000/075348 and has the VH domain of SEQ ID NO: 129 and the VL domain of SEQ ID NO:130. Variants thereof were created as described in the following. For the identification of a suitable human acceptor framework during the humanization of the anti-CD40 binder S2C6, a combination of two methodologies was used. On the one hand, a classical approach was taken by searching for an acceptor framework with high sequence homology, grafting of the CDRs on this framework, and evaluating which back-mutations can be envisaged. More explicitly, each amino acid difference of the identified frameworks to the parental antibody was judged for impact on the structural integrity of the binder, and back mutations towards the parental sequence were introduced whenever appropriate. The structural assessment was based on Fv region homology models of both the parental antibody and its humanized versions created with an in-house antibody structure homology modeling tool implemented using the Biovia Discovery Studio Environment, version 4.5.

On the other hand, an in-house developed in silico tool was used to predict the orientation of the VH and VL domains of the humanized versions towards each other (see WO 2016062734 incorporated herein by reference). The results were compared to the predicted VH-VL domain orientation of the parental binder to select for framework combinations which are close in geometry to the starting antibody. The rational is to detect possible amino acid exchange in the VH-VL interface region that might lead to disruptive changes in the pairing of the two domains. 30)

4.1.2 Choice of Acceptor Framework and Adaptations Thereof

The acceptor framework was chosen as described in Table 12 below:

TABLE 12

| Acceptor framework | | | |
|---|---|---|---|
|  | Murine V-region germline | Choice of human acceptor V-region germline | Identity to human V-region germline after grafting (BLASTp): |
| S2C6 VH | IGHV1-26 * 01 | IGHV1-2 * 01 | 91.8% |
| S2C6 VL | IGKV1-110 * 01 | IGKV2-30 * 02 | 92.0% |

Post-CDR3 framework regions were adapted from human IGHJ germline IGHJ6 * 01/02 (YYYYYGMDV<u>WGQGTTVTVSS</u>) and human IGKJ germline IGKJ1 * 01 (WT<u>FGQGTKVEIK</u>). The part relevant for the acceptor framework is indicated as underlined.

Based on structural considerations, back mutations from the human acceptor framework to the amino acid in the parental binder were introduced at positions H48 (M>I) and H71 (R>V) of the VH region and at positions L36 (F>Y), L46 (R>L) and L87 (Y>F) of the VL region (Kabat numbering). Furthermore, two positions in CDR-H2 were identified as promising candidates for forward mutations, i.e., amino acid exchanges from parental binder to human acceptor germline in order to increase overall human character, namely H60 (N>A) and H64 (K>Q).

In order to address putative developability hotspots (asparagine deamidation), further changes with regard to the parental binder were introduced at positions H52b (N>Q) and H54 (N>A) in VH, and L27f (N>Q), L28 (G>P), L29 (N>Q) and L30 (T>I) in VL (Kabat numbering).

In the following Table 13 the VH-VL pairing matrix is shown:

|  |  | hVK_1 IMGT_ hVK_2_30_ base_graft | hVK_2 bF36Y_ bR46L | hVK_3 bF36Y_ bR46L_ bY87F | hVK_4 bF36Y_ bR46L_ bY87F_ dG28P | hVK_5 bF36Y_ bR46L_ bY87F_ dT30I | hVK_6 bF36Y_ bR46L_ bY87F_ dT30I | hVK_7 bF36Y_ bR46L_ bY87F_ dN27fQ | hVK_8 bF36Y_ bR46L_ bY87F_ dN29Q | hVK_9 bF36Y_ bR46L_ bY87F_ dN27fQ_ dN29Q |
|---|---|---|---|---|---|---|---|---|---|---|
| hVH_1 | IMGT_hVH_1_2_base_graft |  |  |  |  |  |  |  |  |  |
| hVH_2 | bM48I_bR71V |  | x | x | x | x | x | x | x | x |
| hVH_3 | bM48I_bR71V_dN54A |  | x | x | x | x | x | x | x | x |
| hVH_4 | bM48I_bR71V_dN52bQ_dN254A |  | x | x | x | x | x | x | x | x |
| hVH_5 | bM48I_bR71V_fK64Q |  | x | x |  |  |  |  |  |  |
| hVH_6 | bM48I_bR71V_fN60A |  | x | x |  |  |  |  |  |  |
| hVH_7 | bM48I_bR71V_fN60A_fk64Q |  | x | x |  |  |  |  |  |  |

Back mutations prefixed with b, forward mutations prefixed with f, and mutations to address developability hotspots prefixed with d

4.1.3 VH and VL Domains of the Resulting Humanized CD40 Antibodies

The resulting VH domains of humanized CD40) antibodies can be found in Table 14 below and the resulting VL domains of humanized CD40) antibodies are listed in Table 15 below. 5

TABLE 14

Amino acid sequences of the VH domains of humanized CD40 antibodies

| Description | Sequence | Seq ID No |
|---|---|---|
| IMGT_hVH_1 | QVQLVQSGAEVKKPGASVKVSCKASgysftgyyihWVRQAPGQGLEWMGrvipnnggtsynqkfkgRVTSTRDTSISTAYMELSRLRSDDTVVYYCARegiywWGQGTTVTVSS | 45 |
| IMGT_hVH_2 | QVQLVQSGAEVKKPGASVKVSCKASgysftgyyihWVRQAPGQGLEWIGrvipnnggtsynqkfkgRVTSTVDTSISTAYMELSRLRSDDTVVYYCARegiywWGQGTTVTVSS | 46 |
| IMGT_hVH_3 | QVQLVQSGAEVKKPGASVKVSCKASgysftgyyihWVRQAPGQGLEWIGrvipnaggtsynqkfkgRVTSTVDTSISTAYMELSRLRSDDTVVYYCARegiywWGQGTTVTVSS | 47 |
| IMGT_hVH_4 | QVQLVQSGAEVKKPGASVKVSCKASgysftgyyihWVRQAPGQGLEWIGrvipqaggtsynqkfkgRVTSTVDTSISTAYMELSRLRSDDTVVYYCARegiywWGQGTTVTVSS | 48 |
| IMGT_hVH_5 | QVQLVQSGAEVKKPGASVKVSCKASgysftgyyihWVRQAPGQGLEWIGrvipnnggtsynqkfqgRVTSTVDTSISTAYMELSRLRSDDTVVYYCARegiywWGQGTTVTVSS | 49 |
| IMGT_hVH_6 | QVQLVQSGAEVKKPGASVKVSCKASgysftgyyihWVRQAPGQGLEWIGrvipnnggtsyaqkfkgRVTSTVDTSISTAYMELSRLRSDDTVVYYCARegiywWGQGTTVTVSS | 50 |
| IMGT_hVH_7 | QVQLVQSGAEVKKPGASVKVSCKASgysftgyyihWVRQAPGQGLEWIGrvipnnggtsyaqkfqgRVTSTVDTSISTAYMELSRLRSDDTVVYYCARegiywWGQGTTVTVSS | 51 |
| IMGT_hVH_2_N288A | QVQLVQSGAEVKKPGASVKVSCKASgysftgyyihWVRQAPGQGLEWIGrvipnaggtsynqkfkgRVTSTVDTSISTAYMELSRLRSDDTVVYYCARegiywWGQGTTVTVSS | 52 |
| IMGT_hVH_5_N288A | QVQLVQSGAEVKKPGASVKVSCKASgysftgyyihWVRQAPGQGLEWIGrvipnaggtsynqkfqgRVTSTVDTSISTAYMELSRLRSDDTVVYYCARegiywWGQGTTVTVSS | 53 |
| IMGT_hVH_6_N288A | QVQLVQSGAEVKKPGASVKVSCKASgysftgyyihWVRQAPGQGLEWIGrvipnaggtsyaqkfkgRVTSTVDTSISTAYMELSRLRSDDTVVYYCARegiywWGQGTTVTVSS | 54 |
| IMGT_hVH_7_N288A | QVQLVQSGAEVKKPGASVKVSCKASgysftgyyihWVRQAPGQGLEWIGrvipnaggtsyaqkfqgRVTSTVDTSISTAYMELSRLRSDDTVVYYCARegiywWGQGTTVTVSS | 55 |

TABLE 15

Amino acid sequences of the VL domains of humanized CD40 antibodies

| Description | Sequence | Seq ID No |
|---|---|---|
| IMGT_hVK_1 | DVVMTQSPLSLPVTLGQPASISCrssqslvhsngntflhWFQQRPGQSPRRLIYtvsnrfsGVPDRFSGSGSGTDFTLKISRVEAEDVGVYYCsqtthvpwtFGQGTKVEIK | 56 |
| IMGT_hVK_2 | DVVMTQSPLSLPVTLGQPASISCrssqslvhsngntflhWYQQRPGQSPRLLIYtvsnrfsGVPDRFSGSGSGTDFTLKISRVEAEDVGVYYCsqtthvpwtFGQGTKVEIK | 57 |
| IMGT_hVK_3 | DVVMTQSPLSLPVTLGQPASISCrssqslvhsngntflhWYQQRPGQSPRLLIYtvsnrfsGVPDRFSGSGSGTDFTLKISRVEAEDVGVYFCsqtthvpwtFGQGTKVEIK | 58 |

TABLE 15-continued

Amino acid sequences of the VL domains
of humanized CD40 antibodies

| Description | Sequence | Seq ID No |
|---|---|---|
| IMGT_hVK_4 | DVVMTQSPLSLPVTLGQPASISCrssqslvhsnpntflhWYQQ RPGQSPRLLIYtvsnrfsGVPDRFSGSGSGTDFTLKISRVEAE DVGVYFCsqtthvpwtFGQGTKVEIK | 59 |
| IMGT_hVK_5 | DVVMTQSPLSLPVTLGQPASISCrssqslvhsngniflhWYQQ RPGQSPRLLIYtvsnrfsGVPDRFSGSGSGTDFTLKISRVEAE DVGVYFCsqtthvpwtFGQGTKVEIK | 60 |
| IMGT_hVK_6 | DVVMTQSPLSLPVTLGQPASISCrssqslvhsnpniflhWYQQ RPGQSPRLLIYtvsnrfsGVPDRFSGSGSGTDFTLKISRVEAE DVGVYFCsqtthvpwtFGQGTKVEIK | 61 |
| IMGT_hVK_7 | DVVMTQSPLSLPVTLGQPASISCrssqslvhsqgntflhWYQQ RPGQSPRLLIYtvsnrfsGVPDRFSGSGSGTDFTLKISRVEAE DVGVYFCsqtthvpwtFGQGTKVEIK | 62 |
| IMGT_hVK_8 | DVVMTQSPLSLPVTLGQPASISCrssqslvhsngqtflhWYQQ RPGQSPRLLIYtvsnrfsGVPDRFSGSGSGTDFTLKISRVEAE DVGVYFCsqtthvpwtFGQGTKVEIK | 63 |
| IMGT_hVK_9 | DVVMTQSPLSLPVTLGQPASISCrssqslvhsqgqtflhWYQQ RPGQSPRLLIYtvsnrfsGVPDRFSGSGSGTDFTLKISRVEAE DVGVYFCsqtthvpwtFGQGTKVEIK | 64 |

The humanized amino acid sequences for heavy and light chain variable regions of S2C6 variants were backtranslated in to DNA and the resulting cNDA were synthesized (GenArt) and then cloned into heavy chain expression vectors as fusion proteins with human IgG1 backbones/human CH1-Hinge-CH2-CH3 with LALA and PG mutations (Leucine 234 to Alanine, Leucine 235 to Alanine, Proline 329 to Glycine) abrogating effector functions or into light chain expression vectors as fusion proteins to human C-kappa. LC and HC Plasmids were then cotransfected into HEK293 and purified after 7 days from supernatants by standard methods for antibody purification.

4.2 Second Generation of Humanized Variants of Anti-CD40 Antibody S2C6

4.2.1 Methodology

As for Example 4.1, for the identification of a suitable human acceptor framework during the humanization of the anti-CD40 binder S2C6 a combination of two methodologies was used.

On the one hand, a classical approach was taken by searching for an acceptor framework with high sequence homology, grafting of the CDRs on this framework, and evaluating which back-mutations can be envisaged. More explicitly, each amino acid difference of the identified frameworks to the parental antibody was judged for impact on the structural integrity of the binder, and back mutations towards the parental sequence were introduced whenever appropriate. The structural assessment was based on Fv region homology models of both the parental antibody and its humanized versions created with an in-house antibody structure homology modeling tool implemented using the Biovia Discovery Studio Environment, version 4.5.

On the other hand, an in-house developed in silico tool was used to predict the orientation of the VH and VL domains of the humanized versions towards each other (see WO 2016062734 incorporated herein by reference). The results were compared to the predicted VH-VL domain orientation of the parental binder to select for framework combinations which are close in geometry to the starting antibody. The rational is to detect possible amino acid exchange in the VH-VL interface region that might lead to disruptive changes in the pairing of the two domains.

4.2.2 Choice of Acceptor Framework and Adaptations Thereof

Two different acceptor frameworks were chosen as described in Table 16 and Table 18 below.

TABLE 16

Acceptor framework 1: "IGHV1-IGKV2D"

| | Murine V-region germline | Choice of human acceptor V-region germline | Identity to human V-region germline after grafting (BLASTp): |
|---|---|---|---|
| S2C6 VH | IGHV1-26 * 01 | IGHV1-2 * 05 | 91.8% |
| S2C6 VL | IGKV1-110 * 01 | IGKV2D-29 * 02 | 88.0% |

Post-CDR3 framework regions were adapted from human IGHJ germline IGHJ6 * 01/02 (YYYYYGMDVWGQGTTVTVSS) and human IGKJ germline IGKJ4 * 01/02 (LTFGGGTKVEIK). The part relevant for the acceptor framework is indicated in bold script.

Based on structural considerations, back mutations from the human acceptor framework to the amino acid in the parental binder were introduced at positions H43 (Q>K), H44 (G>S), H69 (M>L), H71 (R>V), H73 (T>K), H88 (V>A) and H105 (Q>H) of the VH region and at positions L2 (I>V), L4 (M>V), L87 (Y>F) and L104 (V>L) of the VL region. In one variant, mutation T70S (VH) was included to study the effect of a slightly more hydrophilic residue at this position.

All variants include the N54A mutation (VH) to address a putative developability hotspot (asparagine deamidation). All positions are given in the Kabat EU numbering scheme.

In the following Table 17 the Humanization variant VH-VL pairing matrix is shown:

|  | VL1a bY87F | VL1b bM4V, bY87F | VL1c bI2V, bM4V, bY83F | VL1d bI2V, bM4V, bY783F, bV104L |
|---|---|---|---|---|
| VH1a | bG44S, bM69L, bR71V, bT73K, bV88A | x | x | x | x |
| VH1b | bQ43K, bG44S, bM69L, bR71V, bT73K, bV88A | x | x | x | x |
| VH1c | bG44S, bM69L, bR71V, bT73K, bV88A, bQ105H | x | x | x | x |
| VH1d | bG44S, bM69L, bR71V, bT73K, bV88A, xT70S | x | x | x | x |

Mutation N54A applies to all VH variants and is not explicitly mentioned. Back mutations prefixed with b, forward mutations prefixed with f, and other mutations prefixed with x

TABLE 18

Acceptor framework 2: "IGHV3-IGKV1"

| Murine V-region germline | Choice of human acceptor V-region germline | Identity to human V-region germline after grafting (BLASTp): |
|---|---|---|
| S2C6 VH | IGHV1-26 * 01 | IGHV3-23 * 02 | 79.6% |
| S2C6 VL | IGKV1-110 * 01 | IGKV1-39 * 01 | 79.0% |

Post-CDR3 framework regions were adapted from human IGHJ germline IGHJ6 * 01/02 (YYYYYGMDVWGQGTTVTVSS) and human IGKJ germline IGKJ4 * 01/02 (LTFGGGTKVEIK). The part relevant for the acceptor framework is indicated in bold script.

Based on structural considerations, back mutations from the human acceptor framework to the amino acid in the parental binder were introduced at positions H44 (G>S), H49 (S>G), H71 (R>V), H78 (L>A), H94 (K>R) and H105 (Q>H) of the VH region and at positions L42 (K>Q), L43 (A>S) and L87 (Y>F) of the VL region. Furthermore, four positions in CDR-H2 were identified as promising candidates for forward mutations, i.e., amino acid exchanges from parental binder to human acceptor germline in order to increase overall human character, namely H60 (N>G), H61 (Q>D), H62 (K>S) and H63 (F>V).

All variants include the N54A mutation (VH) to address a putative developability hotspot (asparagine deamidation). All positions are given in the Kabat EU numbering scheme.

In the following Table 19 the Humanization variant VH-VL pairing matrix is shown:

|  | VL2a bY87F | VL2b bK42Q, bA43S, bY87F |
|---|---|---|
| VH2a | bS49G, bR71V, bL78A, bK94R | x | x |
| VH2b | bG44S, bS49G, bR71V, bL78A, bK94R | x | x |
| VH2c | bS49G, bR71V, bL78A, bK94R, bQ105H | x | x |
| VH2d | bS49G, fN60G, fQ61D, fK62S, fF63V, bR71V, bL78A, bK94R | x | x |

Back mutations prefixed with b, forward mutations prefixed with f.

4.2.3 VH and VL Domains of the Resulting Humanized CD40 Antibodies

The resulting VH and VL domains of humanized CD40 antibodies based on acceptor framework 1 can be found in Table 17 below and the resulting VH and VL domains of humanized CD40 antibodies based on acceptor framework 2 are listed in Table 18 below.

TABLE 20

Amino acid sequences of the VH and VL domains of humanized CD40 antibodies based on acceptor framework 1

| Description | Sequence | Seq ID No |
|---|---|---|
| VH1a | QVQLVQSGAEVKKPGASVKVSCKASGYSFTGYYIHWVRQAPGQ SLEWMGRVIPNAGGTSYNQKFKGRVTLTVDKSISTAYMELSRL RSDDTAVYYCAREGIYWWGQGTTVTVSS | 171 |
| VH1b | QVQLVQSGAEVKKPGASVKVSCKASGYSFTGYYIHWVRQAPGK SLEWMGRVIPNAGGTSYNQKFKGRVTLTVDKSISTAYMELSRL RSDDTAVYYCAREGIYWWGQGTTVTVSS | 172 |
| VH1c | QVQLVQSGAEVKKPGASVKVSCKASGYSFTGYYIHWVRQAPGQ SLEWMGRVIPNAGGTSYNQKFKGRVTLTVDKSISTAYMELSRL RSDDTAVYYCAREGIYWWGHGTTVTVSS | 173 |
| VH1d | QVQLVQSGAEVKKPGASVKVSCKASGYSFTGYYIHWVRQAPGQ SLEWMGRVIPNAGGTSYNQKFKGRVTLSVDKSISTAYMELSRL RSDDTAVYYCAREGIYWWGQGTTVTVSS | 174 |
| VL1a | DIVMTQTPLSLSVTPGQPASISCRSSQSLVHSNGNTFLHWYLQ KPGQSPQLLIYTVSNRFSGVPDRFSGSGSGTDFTLKISRVEAE DVGVYFCSQTTHVPWTFGGGTKVEIK | 175 |
| VL1b | DIVVTQTPLSLSVTPGQPASISCRSSQSLVHSNGNTFLHWYLQ KPGQSPQLLIYTVSNRFSGVPDRFSGSGSGTDFTLKISRVEAE DVGVYFCSQTTHVPWTFGGGTKVEIK | 176 |
| VL1c | DVVVTQTPLSLSVTPGQPASISCRSSQSLVHSNGNTFLHWYLQ KPGQSPQLLIYTVSNRFSGVPDRFSGSGSGTDFTLKISRVEAE DVGVYFCSQTTHVPWTFGGGTKVEIK | 177 |

TABLE 20-continued

Amino acid sequences of the VH and VL domains of humanized CD40 antibodies based on acceptor framework 1

| Description | Sequence | Seq ID No |
|---|---|---|
| VL1d | DVVVTQTPLSLSVTPGQPASISCRSSQSLVHSNGNTFLHWYLQ KPGQSPQLLIYTVSNRFSGVPDRFSGSGSGTDFTLKISRVEAE DVGVYFCSQTTHVPWTFGGGTKLEIK | 178 |

TABLE 21

Amino acid sequences of the VH and VL domains of humanized CD40 antibodies based on acceptor framework 2

| Description | Sequence | Seq ID No |
|---|---|---|
| VH2a | EVQLLESGGGLVQPGGSLRLSCAASGYSFTGYYIHWVRQAPGK GLEWVGRVIPNAGGTSYNQKFKGRFTISVDNSKNTAYLQMNSL RAEDTAVYYCAREGIYWWGQGTTVTVSS | 179 |
| VH2b | EVQLLESGGGLVQPGGSLRLSCAASGYSFTGYYIHWVRQAPGK SLEWVGRVIPNAGGTSYNQKFKGRFTISVDNSKNTAYLQMNSL RAEDTAVYYCAREGIYWWGQGTTVTVSS | 180 |
| VH2c | EVQLLESGGGLVQPGGSLRLSCAASGYSFTGYYIHWVRQAPGK GLEWVGRVIPNAGGTSYNQKFKGRFTISVDNSKNTAYLQMNSL RAEDTAVYYCAREGIYWWGHGTTVTVSS | 181 |
| VH2d | EVQLLESGGGLVQPGGSLRLSCAASGYSFTGYYIHWVRQAPGK GLEWVGRVIPNAGGTSYGDSVKGRFTISVDNSKNTAYLQMNSL RAEDTAVYYCAREGIYWWGQGTTVTVSS | 182 |
| VH2ab | EVQLLESGGGLVQPGGSLRLSCAASGYSFTGYYMHWVRQAPGK GLEWVGRVIPNAGGTSYNQKFKGRFTISVDNSKNTAYLQMNSL RAEDTAVYYCAREGIYWWGQGTTVTVSS | 183 |
| VH2ac | EVQLLESGGGLVQPGGSLRLSCAASGYSFTGYYIHWVRQAPGK GLEWVGRVIPNAGGTSYNQKVKGRFTISVDNSKNTAYLQMNSL RAEDTAVYYCAREGIYWWGQGTTVTVSS | 184 |
| VL2a | DIQMTQSPSSLSASVGDRVTITCRSSQSLVHSNGNTFLHWYQQ KPGKAPKLLIYTVSNRFSGVPSRFSGSGSGTDFTLTISSLQPE DFATYFCSQTTHVPWTFGGGTKVEIK | 185 |
| VL2b | DIQMTQSPSSLSASVGDRVTITCRSSQSLVHSNGNTFLHWYQQ KPGQSPKLLIYTVSNRFSGVPSRFSGSGSGTDFTLTISSLQPE DFATYFCSQTTHVPWTFGGGTKVEIK | 186 |
| VL2ab | DIQMTQSPSSLSASVGDRVTITCRASQSLVHSNGNTFLHWYQQ KPGKAPKLLIYTVSNRFSGVPSRFSGSGSGTDFTLTISSLQPE DFATYFCSQTTHVPWTFGGGTKVEIK | 187 |
| VL2ac | DIQMTQSPSSLSASVGDRVTITCRSSQSIVHSNGNTFLHWYQQ KPGKAPKLLIYTVSNRFSGVPSRFSGSGSGTDFTLTISSLQPE DFATYFCSQTTHVPWTFGGGTKVEIK | 188 |

4.2.4 New Humanized CD40 Antibodies in huIgG1_LALA_PG Format

Based on the new humanization variants of VH and VL new CD40 antibodies were expressed as huIgG1 antibodies with an effector silent Fc (P329G; L234, L235A) to abrogate binding to Fcγ receptors according to the method described in WO 2012/130831 A1.

TABLE 22

Nomenclature for VH/VL combinations expressed as huIgG1_LALA_PG antibodies

| | VL1a | VL1b | VL1c | VL1d | VL2a | VL2b | VL2ab | VL2ac |
|---|---|---|---|---|---|---|---|---|
| VH1a | P1AE 0817 | P1AE 1001 | P1AE 0993 | P1AE 0996 | | | | |

TABLE 22-continued

Nomenclature for VH/VL combinations expressed as huIgG1_LALA_PG antibodies

| | VL1a | VL1b | VL1c | VL1d | VL2a | VL2b | VL2ab | VL2ac |
|---|---|---|---|---|---|---|---|---|
| VH1b | P1AE 1002 | P1AE 1003 | P1AE 1004 | P1AE 1005 | | | | |
| VH1c | P1AE 0997 | P1AE 1006 | P1AE 0818 | P1AE 0998 | | | | |
| VH1d | P1AE 0999 | P1AE 1007 | P1AE 1000 | P1AE 0819 | | | | |
| VH2a | | | | | P1AE 0400 | P1AE 0404 | | |
| VH2b | | | | | P1AE 0401 | P1AE 0405 | | |
| VH2c | | | | | P1AE 0402 | P1AE 0406 | | |
| VH2d | | | | | P1AE 0403 | P1AE 0407 | | |
| VH2ab | | | | | | | P1AE 1125 | P1AE 1126 |
| VH2ac | | | | | | | P1AE 1134 | P1AE 1135 |

The full-length sequences of humanized CD40 antibodies as human IgG1_LALAPG antibodies can be found in Table 20.

TABLE 23

Amino acid sequences of the humanized CD40 IgG1_LALAPG antibodies

| Antibody | Sequence | Seq ID No |
|---|---|---|
| P1AE0400 heavy chain | EVQLLESGGGLVQPGGSLRLSCAASGYSFTGYYIHWVRQAPGK GLEWVGRVIPNAGGTSYNQKFKGRFTISVDNSKNTAYLQMNSL RAEDTAVYYCAREGIYWWGQGTTVTVSSASTKGPSVFPLAPSS KSTSGGTAALGCLVKDYFPEPVTVSWNSGALTSGVHTFPAVLQ SSGLYSLSSVVTVPSSSLGTQTYICNVNHKPSNTKVDKKVEPK SCDKTHTCPPCPAPEAAGGPSVFLFPPKPKDTLMISRTPEVTC VVVDVSHEDPEVKFNWYVDGVEVHNAKTKPREEQYNSTYRVVS VLTVLHQDWLNGKEYKCKVSNKALGAPIEKTISKAKGQPREPQ VYTLPPSRDELTKNQVSLTCLVKGFYPSDIAVEWESNGQPENN YKTTPPVLDSDGSFFLYSKLTVDKSRWQQGNVFSCSVMHEALH NHYTQKSLSLSPG | 189 |
| P1AE0400 light chain | DIQMTQSPSSLSASVGDRVTITCRSSQSLVHSNGNTFLHWYQQ KPGKAPKLLIYTVSNRFSGVPSRFSGSGSGTDFTLTISSLQPE DFATYFCSQTTHVPWTFGGGTKVEIKRTVAAPSVFIFPPSDEQ LKSGTASVVCLLNNFYPREAKVQWKVDNALQSGNSQESVTEQD SKDSTYSLSSTLTLSKADYEKHKVYACEVTHQGLSSPVTKSFN RGEC | 190 |
| P1AE0401 heavy chain | EVQLLESGGGLVQPGGSLRLSCAASGYSFTGYYIHWVRQAPGK SLEWVGRVIPNAGGTSYNQKFKGRFTISVDNSKNTAYLQMNSL RAEDTAVYYCAREGIYWWGQGTTVTVSSASTKGPSVFPLAPSS KSTSGGTAALGCLVKDYFPEPVTVSWNSGALTSGVHTFPAVLQ SSGLYSLSSVVTVPSSSLGTQTYICNVNHKPSNTKVDKKVEPK SCDKTHTCPPCPAPEAAGGPSVFLFPPKPKDTLMISRTPEVTC VVVDVSHEDPEVKFNWYVDGVEVHNAKTKPREEQYNSTYRVVS VLTVLHQDWLNGKEYKCKVSNKALGAPIEKTISKAKGQPREPQ VYTLPPSRDELTKNQVSLTCLVKGFYPSDIAVEWESNGQPENN YKTTPPVLDSDGSFFLYSKLTVDKSRWQQGNVFSCSVMHEALH NHYTQKSLSLSPG | 191 |
| P1AE0401 light chain | DIQMTQSPSSLSASVGDRVTITCRSSQSLVHSNGNTFLHWYQQ KPGKAPKLLIYTVSNRFSGVPSRFSGSGSGTDFTLTISSLQPE DFATYFCSQTTHVPWTFGGGTKVEIKRTVAAPSVFIFPPSDEQ LKSGTASVVCLLNNFYPREAKVQWKVDNALQSGNSQESVTEQD SKDSTYSLSSTLTLSKADYEKHKVYACEVTHQGLSSPVTKSFN RGEC | 192 |
| P1AE0402 heavy chain | EVQLLESGGGLVQPGGSLRLSCAASGYSFTGYYIHWVRQAPGK GLEWVGRVIPNAGGTSYNQKFKGRFTISVDNSKNTAYLQMNSL RAEDTAVYYCAREGIYWWGHGTTVTVSSASTKGPSVFPLAPSS KSTSGGTAALGCLVKDYFPEPVTVSWNSGALTSGVHTFPAVLQ SSGLYSLSSVVTVPSSSLGTQTYICNVNHKPSNTKVDKKVEPK SCDKTHTCPPCPAPEAAGGPSVFLFPPKPKDTLMISRTPEVTC VVVDVSHEDPEVKFNWYVDGVEVHNAKTKPREEQYNSTYRVVS VLTVLHQDWLNGKEYKCKVSNKALGAPIEKTISKAKGQPREPQ | 193 |

TABLE 23-continued

Amino acid sequences of the humanized
CD40_IgG1_LALAPG antibodies

| Antibody | Sequence | Seq ID No |
|---|---|---|
| | VYTLPPSRDELTKNQVSLTCLVKGFYPSDIAVEWESNGQPENN YKTTPPVLDSDGSFFLYSKLTVDKSRWQQGNVFSCSVMHEALH NHYTQKSLSLSPG | |
| P1AE0402 light chain | DIQMTQSPSSLSASVGDRVTITCRSSQSLVHSNGNTFLHWYQQ KPGKAPKLLIYTVSNRFSGVPSRFSGSGSGTDFTLTISSLQPE DFATYFCSQTTHVPWTFGGGTKVEIKRTVAAPSVFIFPPSDEQ LKSGTASVVCLLNNFYPREAKVQWKVDNALQSGNSQESVTEQD SKDSTYSLSSTLTLSKADYEKHKVYACEVTHQGLSSPVTKSFN RGEC | 194 |
| P1AE0403 heavy chain | EVQLLESGGGLVQPGGSLRLSCAASGYSFTGYYIHWVRQAPGK GLEWVGRVIPNAGGTSYGDSVKGRFTISVDNSKNTAYLQMNSL RAEDTAVYYCAREGIYWWGQGTTVTVSSASTKGPSVFPLAPSS KSTSGGTAALGCLVKDYFPEPVTVSWNSGALTSGVHTFPAVLQ SSGLYSLSSVVTVPSSSLGTQTYICNVNHKPSNTKVDKKVEPK SCDKTHTCPPCPAPEAAGGPSVFLFPPKPKDTLMISRTPEVTC VVVDVSHEDPEVKFNWYVDGVEVHNAKTKPREEQYNSTYRVVS VLTVLHQDWLNGKEYKCKVSNKALGAPIEKTISKAKGQPREPQ VYTLPPSRDELTKNQVSLTCLVKGFYPSDIAVEWESNGQPENN YKTTPPVLDSDGSFFLYSKLTVDKSRWQQGNVFSCSVMHEALH NHYTQKSLSLSPG | 195 |
| P1AE0403 light chain | DIQMTQSPSSLSASVGDRVTITCRSSQSLVHSNGNTFLHWYQQ KPGKAPKLLIYTVSNRFSGVPSRFSGSGSGTDFTLTISSLQPE DFATYFCSQTTHVPWTFGGGTKVEIKRTVAAPSVFIFPPSDEQ LKSGTASVVCLLNNFYPREAKVQWKVDNALQSGNSQESVTEQD SKDSTYSLSSTLTLSKADYEKHKVYACEVTHQGLSSPVTKSFN RGEC | 196 |
| P1AE0404 heavy chain | EVQLLESGGGLVQPGGSLRLSCAASGYSFTGYYIHWVRQAPGK GLEWVGRVIPNAGGTSYNQKFKGRFTISVDNSKNTAYLQMNSL RAEDTAVYYCAREGIYWWGQGTTVTVSSASTKGPSVFPLAPSS KSTSGGTAALGCLVKDYFPEPVTVSWNSGALTSGVHTFPAVLQ SSGLYSLSSVVTVPSSSLGTQTYICNVNHKPSNTKVDKKVEPK SCDKTHTCPPCPAPEAAGGPSVFLFPPKPKDTLMISRTPEVTC VVVDVSHEDPEVKFNWYVDGVEVHNAKTKPREEQYNSTYRVVS VLTVLHQDWLNGKEYKCKVSNKALGAPIEKTISKAKGQPREPQ VYTLPPSRDELTKNQVSLTCLVKGFYPSDIAVEWESNGQPENN YKTTPPVLDSDGSFFLYSKLTVDKSRWQQGNVFSCSVMHEALH NHYTQKSLSLSPG | 197 |
| P1AE0404 light chain | DIQMTQSPSSLSASVGDRVTITCRSSQSLVHSNGNTFLHWYQQ KPGQSPKLLIYTVSNRFSGVPSRFSGSGSGTDFTLTISSLQPE DFATYFCSQTTHVPWTFGGGTKVEIKRTVAAPSVFIFPPSDEQ LKSGTASVVCLLNNFYPREAKVQWKVDNALQSGNSQESVTEQD SKDSTYSLSSTLTLSKADYEKHKVYACEVTHQGLSSPVTKSFN RGEC | 198 |
| P1AE0405 heavy chain | EVQLLESGGGLVQPGGSLRLSCAASGYSFTGYYIHWVRQAPGK SLEWVGRVIPNAGGTSYNQKFKGRFTISVDNSKNTAYLQMNSL RAEDTAVYYCAREGIYWWGQGTTVTVSSASTKGPSVFPLAPSS KSTSGGTAALGCLVKDYFPEPVTVSWNSGALTSGVHTFPAVLQ SSGLYSLSSVVTVPSSSLGTQTYICNVNHKPSNTKVDKKVEPK SCDKTHTCPPCPAPEAAGGPSVFLFPPKPKDTLMISRTPEVTC VVVDVSHEDPEVKFNWYVDGVEVHNAKTKPREEQYNSTYRVVS VLTVLHQDWLNGKEYKCKVSNKALGAPIEKTISKAKGQPREPQ VYTLPPSRDELTKNQVSLTCLVKGFYPSDIAVEWESNGQPENN YKTTPPVLDSDGSFFLYSKLTVDKSRWQQGNVFSCSVMHEALH NHYTQKSLSLSPG | 199 |
| P1AE0405 light chain | DIQMTQSPSSLSASVGDRVTITCRSSQSLVHSNGNTFLHWYQQ KPGQSPKLLIYTVSNRFSGVPSRFSGSGSGTDFTLTISSLQPE DFATYFCSQTTHVPWTFGGGTKVEIKRTVAAPSVFIFPPSDEQ LKSGTASVVCLLNNFYPREAKVQWKVDNALQSGNSQESVTEQD SKDSTYSLSSTLTLSKADYEKHKVYACEVTHQGLSSPVTKSFN RGEC | 200 |
| P1AE0406 heavy chain | EVQLLESGGGLVQPGGSLRLSCAASGYSFTGYYIHWVRQAPGK GLEWVGRVIPNAGGTSYNQKFKGRFTISVDNSKNTAYLQMNSL RAEDTAVYYCAREGIYWWGHGTTVTVSSASTKGPSVFPLAPSS KSTSGGTAALGCLVKDYFPEPVTVSWNSGALTSGVHTFPAVLQ SSGLYSLSSVVTVPSSSLGTQTYICNVNHKPSNTKVDKKVEPK SCDKTHTCPPCPAPEAAGGPSVFLFPPKPKDTLMISRTPEVTC | 201 |

TABLE 23-continued

Amino acid sequences of the humanized
CD40_IgG1_LALAPG antibodies

| Antibody | Sequence | Seq ID No |
|---|---|---|
| | VVVDVSHEDPEVKFNWYVDGVEVHNAKTKPREEQYNSTYRVVS VLTVLHQDWLNGKEYKCKVSNKALGAPIEKTISKAKGQPREPQ VYTLPPSRDELTKNQVSLTCLVKGFYPSDIAVEWESNGQPENN YKTTPPVLDSDGSFFLYSKLTVDKSRWQQGNVFSCSVMHEALH NHYTQKSLSLSPG | |
| P1AE0406 light chain | DIQMTQSPSSLSASVGDRVTITCRSSQSLVHSNGNTFLHWYQQ KPGQSPKLLIYTVSNRFSGVPSRFSGSGSGTDFTLTISSLQPE DFATYFCSQTTHVPWTFGGGTKVEIKRTVAAPSVFIFPPSDEQ LKSGTASVVCLLNNFYPREAKVQWKVDNALQSGNSQESVTEQD SKDSTYSLSSTLTLSKADYEKHKVYACEVTHQGLSSPVTKSFN RGEC | 202 |
| P1AE0407 heavy chain | EVQLLESGGGLVQPGGSLRLSCAASGYSFTGYYIHWVRQAPGK GLEWVGRVIPNAGGTSYGDSVKGRFTISVDNSKNTAYLQMNSL RAEDTAVYYCAREGIYWWGQGTTVTVSSASTKGPSVFPLAPSS KSTSGGTAALGCLVKDYFPEPVTVSWNSGALTSGVHTFPAVLQ SSGLYSLSSVVTVPSSSLGTQTYICNVNHKPSNTKVDKKVEPK SCDKTHTCPPCPAPEAAGGPSVFLFPPKPKDTLMISRTPEVTC VVVDVSHEDPEVKFNWYVDGVEVHNAKTKPREEQYNSTYRVVS VLTVLHQDWLNGKEYKCKVSNKALGAPIEKTISKAKGQPREPQ VYTLPPSRDELTKNQVSLTCLVKGFYPSDIAVEWESNGQPENN YKTTPPVLDSDGSFFLYSKLTVDKSRWQQGNVFSCSVMHEALH NHYTQKSLSLSPG | 203 |
| P1AE0407 light chain | DIQMTQSPSSLSASVGDRVTITCRSSQSLVHSNGNTFLHWYQQ KPGQSPKLLIYTVSNRFSGVPSRFSGSGSGTDFTLTISSLQPE DFATYFCSQTTHVPWTFGGGTKVEIKRTVAAPSVFIFPPSDEQ LKSGTASVVCLLNNFYPREAKVQWKVDNALQSGNSQESVTEQD SKDSTYSLSSTLTLSKADYEKHKVYACEVTHQGLSSPVTKSFN RGEC | 204 |
| P1AE0816 heavy chain (control) | QVQLVQSGAEVKKPGASVKVSCKASGYSFTGYYIHWVRQAPGQ SLEWMGRVIPNNGGTSYNQKFQGRVTISVDKSISTAYMELSSL RSEDTAVYYCAREGIYWWGHGTTVTVSSASTKGPSVFPLAPSS KSTSGGTAALGCLVKDYFPEPVTVSWNSGALTSGVHTFPAVLQ SSGLYSLSSVVTVPSSSLGTQTYICNVNHKPSNTKVDKKVEPK SCDKTHTCPPCPAPEAAGGPSVFLFPPKPKDTLMISRTPEVTC VVVDVSHEDPEVKFNWYVDGVEVHNAKTKPREEQYNSTYRVVS VLTVLHQDWLNGKEYKCKVSNKALGAPIEKTISKAKGQPREPQ VYTLPPSRDELTKNQVSLTCLVKGFYPSDIAVEWESNGQPENN YKTTPPVLDSDGSFFLYSKLTVDKSRWQQGNVFSCSVMHEALH NHYTQKSLSLSPG | 259 |
| P1AE0816 light chain (control) | DVVVTQSPLSLPVTPGEPASISCRSSQSLVHSNGNTFLHWYLQ KPGQSPQLLIYTVSNRFSGVPDRFSGSGSGTDFTLKISRVEAE DVGVYFCSQTTHVPWTFGGGTKLEIKRTVAAPSVFIFPPSDEQ LKSGTASVVCLLNNFYPREAKVQWKVDNALQSGNSQESVTEQD SKDSTYSLSSTLTLSKADYEKHKVYACEVTHQGLSSPVTKSFN RGEC | 260 |
| P1AE0817 heavy chain | QVQLVQSGAEVKKPGASVKVSCKASGYSFTGYYIHWVRQAPGQ SLEWMGRVIPNAGGTSYNQKFKGRVTLTVDKSISTAYMELSRL RSDDTAVYYCAREGIYWWGQGTTVTVSSASTKGPSVFPLAPSS KSTSGGTAALGCLVKDYFPEPVTVSWNSGALTSGVHTFPAVLQ SSGLYSLSSVVTVPSSSLGTQTYICNVNHKPSNTKVDKKVEPK SCDKTHTCPPCPAPEAAGGPSVFLFPPKPKDTLMISRTPEVTC VVVDVSHEDPEVKFNWYVDGVEVHNAKTKPREEQYNSTYRVVS VLTVLHQDWLNGKEYKCKVSNKALGAPIEKTISKAKGQPREPQ VYTLPPSRDELTKNQVSLTCLVKGFYPSDIAVEWESNGQPENN YKTTPPVLDSDGSFFLYSKLTVDKSRWQQGNVFSCSVMHEALH NHYTQKSLSLSPG | 205 |
| P1AE0817 light chain | DIVMTQTPLSLSVTPGQPASISCRSSQSLVHSNGNTFLHWYLQ KPGQSPQLLIYTVSNRFSGVPDRFSGSGSGTDFTLKISRVEAE DVGVYFCSQTTHVPWTFGGGTKVEIKRTVAAPSVFIFPPSDEQ LKSGTASVVCLLNNFYPREAKVQWKVDNALQSGNSQESVTEQD SKDSTYSLSSTLTLSKADYEKHKVYACEVTHQGLSSPVTKSFN RGEC | 206 |
| P1AE0818 heavy chain | QVQLVQSGAEVKKPGASVKVSCKASGYSFTGYYIHWVRQAPGQ SLEWMGRVIPNAGGTSYNQKFKGRVTLTVDKSISTAYMELSRL RSDDTAVYYCAREGIYWWGHGTTVTVSSASTKGPSVFPLAPSS KSTSGGTAALGCLVKDYFPEPVTVSWNSGALTSGVHTFPAVLQ | 207 |

TABLE 23-continued

Amino acid sequences of the humanized CD40 IgG1_LALAPG antibodies

| Antibody | Sequence | Seq ID No |
|---|---|---|
| | SSGLYSLSSVVTVPSSSLGTQTYICNVNHKPSNTKVDKKVEPK SCDKTHTCPPCPAPEAAGGPSVFLFPPKPKDTLMISRTPEVTC VVVDVSHEDPEVKFNWYVDGVEVHNAKTKPREEQYNSTYRVVS VLTVLHQDWLNGKEYKCKVSNKALGAPIEKTISKAKGQPREPQ VYTLPPSRDELTKNQVSLTCLVKGFYPSDIAVEWESNGQPENN YKTTPPVLDSDGSFFLYSKLTVDKSRWQQGNVFSCSVMHEALH NHYTQKSLSLSPG | |
| P1AE0818 light chain | DVVVTQTPLSLSVTPGQPASISCRSSQSLVHSNGNTFLHWYLQ KPGQSPQLLIYTVSNRFSGVPDRFSGSGSGTDFTLKISRVEAE DVGVYFCSQTTHVPWTFGGGTKVEIKRTVAAPSVFIFPPSDEQ LKSGTASVVCLLNNFYPREAKVQWKVDNALQSGNSQESVTEQD SKDSTYSLSSTLTLSKADYEKHKVYACEVTHQGLSSPVTKSFN RGEC | 208 |
| P1AE0819 heavy chain | QVQLVQSGAEVKKPGASVKVSCKASGYSFTGYYIHWVRQAPGQ SLEWMGRVIPNAGGTSYNQKFKGRVTLSVDKSISTAYMELSRL RSDDTAVYYCAREGIYWWGQGTTVTVSSASTKGPSVFPLAPSS KSTSGGTAALGCLVKDYFPEPVTVSWNSGALTSGVHTFPAVLQ SSGLYSLSSVVTVPSSSLGTQTYICNVNHKPSNTKVDKKVEPK SCDKTHTCPPCPAPEAAGGPSVFLFPPKPKDTLMISRTPEVTC VVVDVSHEDPEVKFNWYVDGVEVHNAKTKPREEQYNSTYRVVS VLTVLHQDWLNGKEYKCKVSNKALGAPIEKTISKAKGQPREPQ VYTLPPSRDELTKNQVSLTCLVKGFYPSDIAVEWESNGQPENN YKTTPPVLDSDGSFFLYSKLTVDKSRWQQGNVFSCSVMHEALH NHYTQKSLSLSPG | 209 |
| P1AE0819 light chain | DVVVTQTPLSLSVTPGQPASISCRSSQSLVHSNGNTFLHWYLQ KPGQSPQLLIYTVSNRFSGVPDRFSGSGSGTDFTLKISRVEAE DVGVYFCSQTTHVPWTFGGGTKLEIKRTVAAPSVFIFPPSDEQ LKSGTASVVCLLNNFYPREAKVQWKVDNALQSGNSQESVTEQD SKDSTYSLSSTLTLSKADYEKHKVYACEVTHQGLSSPVTKSFN RGEC | 210 |
| P1AE0993 heavy chain | QVQLVQSGAEVKKPGASVKVSCKASGYSFTGYYIHWVRQAPGQ SLEWMGRVIPNAGGTSYNQKFKGRVTLTVDKSISTAYMELSRL RSDDTAVYYCAREGIYWWGQGTTVTVSSASTKGPSVFPLAPSS KSTSGGTAALGCLVKDYFPEPVTVSWNSGALTSGVHTFPAVLQ SSGLYSLSSVVTVPSSSLGTQTYICNVNHKPSNTKVDKKVEPK SCDKTHTCPPCPAPEAAGGPSVFLFPPKPKDTLMISRTPEVTC VVVDVSHEDPEVKFNWYVDGVEVHNAKTKPREEQYNSTYRVVS VLTVLHQDWLNGKEYKCKVSNKALGAPIEKTISKAKGQPREPQ VYTLPPSRDELTKNQVSLTCLVKGFYPSDIAVEWESNGQPENN YKTTPPVLDSDGSFFLYSKLTVDKSRWQQGNVFSCSVMHEALH NHYTQKSLSLSPG | 211 |
| P1AE0993 light chain | DVVVTQTPLSLSVTPGQPASISCRSSQSLVHSNGNTFLHWYLQ KPGQSPQLLIYTVSNRFSGVPDRFSGSGSGTDFTLKISRVEAE DVGVYFCSQTTHVPWTFGGGTKVEIKRTVAAPSVFIFPPSDEQ LKSGTASVVCLLNNFYPREAKVQWKVDNALQSGNSQESVTEQD SKDSTYSLSSTLTLSKADYEKHKVYACEVTHQGLSSPVTKSFN RGEC | 212 |
| P1AE0996 heavy chain | QVQLVQSGAEVKKPGASVKVSCKASGYSFTGYYIHWVRQAPGQ SLEWMGRVIPNAGGTSYNQKFKGRVTLTVDKSISTAYMELSRL RSDDTAVYYCAREGIYWWGQGTTVTVSSASTKGPSVFPLAPSS KSTSGGTAALGCLVKDYFPEPVTVSWNSGALTSGVHTFPAVLQ SSGLYSLSSVVTVPSSSLGTQTYICNVNHKPSNTKVDKKVEPK SCDKTHTCPPCPAPEAAGGPSVFLFPPKPKDTLMISRTPEVTC VVVDVSHEDPEVKFNWYVDGVEVHNAKTKPREEQYNSTYRVVS VLTVLHQDWLNGKEYKCKVSNKALGAPIEKTISKAKGQPREPQ VYTLPPSRDELTKNQVSLTCLVKGFYPSDIAVEWESNGQPENN YKTTPPVLDSDGSFFLYSKLTVDKSRWQQGNVFSCSVMHEALH NHYTQKSLSLSPG | 213 |
| P1AE0996 light chain | DVVVTQTPLSLSVTPGQPASISCRSSQSLVHSNGNTFLHWYLQ KPGQSPQLLIYTVSNRFSGVPDRFSGSGSGTDFTLKISRVEAE DVGVYFCSQTTHVPWTFGGGTKLEIKRTVAAPSVFIFPPSDEQ LKSGTASVVCLLNNFYPREAKVQWKVDNALQSGNSQESVTEQD SKDSTYSLSSTLTLSKADYEKHKVYACEVTHQGLSSPVTKSFN RGEC | 214 |

TABLE 23-continued

Amino acid sequences of the humanized
CD40 IgG1 LALAPG antibodies

| Antibody | Sequence | Seq ID No |
|---|---|---|
| P1AE0997 heavy chain | QVQLVQSGAEVKKPGASVKVSCKASGYSFTGYYIHWVRQAPGQ SLEWMGRVIPNAGGTSYNQKFKGRVTLTVDKSISTAYMELSRL RSDDTAVYYCAREGIYWWGHGTTVTVSSASTKGPSVFPLAPSS KSTSGGTAALGCLVKDYFPEPVTVSWNSGALTSGVHTFPAVLQ SSGLYSLSSVVTVPSSSLGTQTYICNVNHKPSNTKVDKKVEPK SCDKTHTCPPCPAPEAAGGPSVFLFPPKPKDTLMISRTPEVTC VVVDVSHEDPEVKFNWYVDGVEVHNAKTKPREEQYNSTYRVVS VLTVLHQDWLNGKEYKCKVSNKALGAPIEKTISKAKGQPREPQ VYTLPPSRDELTKNQVSLTCLVKGFYPSDIAVEWESNGQPENN YKTTPPVLDSDGSFFLYSKLTVDKSRWQQGNVFSCSVMHEALH NHYTQKSLSLSPG | 215 |
| P1AE0997 light chain | DIVMTQTPLSLSVTPGQPASISCRSSQSLVHSNGNTFLHWYLQ KPGQSPQLLIYTVSNRFSGVPDRFSGSGSGTDFTLKISRVEAE DVGVYFCSQTTHVPWTFGGGTKVEIKRTVAAPSVFIFPPSDEQ LKSGTASVVCLLNNFYPREAKVQWKVDNALQSGNSQESVTEQD SKDSTYSLSSTLTLSKADYEKHKVYACEVTHQGLSSPVTKSFN RGEC | 216 |
| P1AE0998 heavy chain | QVQLVQSGAEVKKPGASVKVSCKASGYSFTGYYIHWVRQAPGQ SLEWMGRVIPNAGGTSYNQKFKGRVTLTVDKSISTAYMELSRL RSDDTAVYYCAREGIYWWGHGTTVTVSSASTKGPSVFPLAPSS KSTSGGTAALGCLVKDYFPEPVTVSWNSGALTSGVHTFPAVLQ SSGLYSLSSVVTVPSSSLGTQTYICNVNHKPSNTKVDKKVEPK SCDKTHTCPPCPAPEAAGGPSVFLFPPKPKDTLMISRTPEVTC VVVDVSHEDPEVKFNWYVDGVEVHNAKTKPREEQYNSTYRVVS VLTVLHQDWLNGKEYKCKVSNKALGAPIEKTISKAKGQPREPQ VYTLPPSRDELTKNQVSLTCLVKGFYPSDIAVEWESNGQPENN YKTTPPVLDSDGSFFLYSKLTVDKSRWQQGNVFSCSVMHEALH NHYTQKSLSLSPG | 217 |
| P1AE0998 light chain | DVVVTQTPLSLSVTPGQPASISCRSSQSLVHSNGNTFLHWYLQ KPGQSPQLLIYTVSNRFSGVPDRFSGSGSGTDFTLKISRVEAE DVGVYFCSQTTHVPWTFGGGTKLEIKRTVAAPSVFIFPPSDEQ LKSGTASVVCLLNNFYPREAKVQWKVDNALQSGNSQESVTEQD SKDSTYSLSSTLTLSKADYEKHKVYACEVTHQGLSSPVTKSFN RGEC | 218 |
| P1AE0999 heavy chain | QVQLVQSGAEVKKPGASVKVSCKASGYSFTGYYIHWVRQAPGQ SLEWMGRVIPNAGGTSYNQKFKGRVTLSVDKSISTAYMELSRL RSDDTAVYYCAREGIYWWGQGTTVTVSSASTKGPSVFPLAPSS KSTSGGTAALGCLVKDYFPEPVTVSWNSGALTSGVHTFPAVLQ SSGLYSLSSVVTVPSSSLGTQTYICNVNHKPSNTKVDKKVEPK SCDKTHTCPPCPAPEAAGGPSVFLFPPKPKDTLMISRTPEVTC VVVDVSHEDPEVKFNWYVDGVEVHNAKTKPREEQYNSTYRVVS VLTVLHQDWLNGKEYKCKVSNKALGAPIEKTISKAKGQPREPQ VYTLPPSRDELTKNQVSLTCLVKGFYPSDIAVEWESNGQPENN YKTTPPVLDSDGSFFLYSKLTVDKSRWQQGNVFSCSVMHEALH NHYTQKSLSLSPG | 219 |
| P1AE0999 light chain | DIVMTQTPLSLSVTPGQPASISCRSSQSLVHSNGNTFLHWYLQ KPGQSPQLLIYTVSNRFSGVPDRFSGSGSGTDFTLKISRVEAE DVGVYFCSQTTHVPWTFGGGTKVEIKRTVAAPSVFIFPPSDEQ LKSGTASVVCLLNNFYPREAKVQWKVDNALQSGNSQESVTEQD SKDSTYSLSSTLTLSKADYEKHKVYACEVTHQGLSSPVTKSFN RGEC | 220 |
| P1AE1000 heavy chain | QVQLVQSGAEVKKPGASVKVSCKASGYSFTGYYIHWVRQAPGQ SLEWMGRVIPNAGGTSYNQKFKGRVTLSVDKSISTAYMELSRL RSDDTAVYYCAREGIYWWGQGTTVTVSSASTKGPSVFPLAPSS KSTSGGTAALGCLVKDYFPEPVTVSWNSGALTSGVHTFPAVLQ SSGLYSLSSVVTVPSSSLGTQTYICNVNHKPSNTKVDKKVEPK SCDKTHTCPPCPAPEAAGGPSVFLFPPKPKDTLMISRTPEVTC VVVDVSHEDPEVKFNWYVDGVEVHNAKTKPREEQYNSTYRVVS VLTVLHQDWLNGKEYKCKVSNKALGAPIEKTISKAKGQPREPQ VYTLPPSRDELTKNQVSLTCLVKGFYPSDIAVEWESNGQPENN YKTTPPVLDSDGSFFLYSKLTVDKSRWQQGNVFSCSVMHEALH NHYTQKSLSLSPG | 221 |

TABLE 23-continued

Amino acid sequences of the humanized
CD40_IgG1_LALAPG antibodies

| Antibody | Sequence | Seq ID No |
|---|---|---|
| P1AE1000 light chain | DVVVTQTPLSLSVTPGQPASISCRSSQSLVHSNGNTFLHWYLQ KPGQSPQLLIYTVSNRFSGVPDRFSGSGSGTDFTLKISRVEAE DVGVYFCSQTTHVPWTFGGGTKVEIKRTVAAPSVFIFPPSDEQ LKSGTASVVCLLNNFYPREAKVQWKVDNALQSGNSQESVTEQD SKDSTYSLSSTLTLSKADYEKHKVYACEVTHQGLSSPVTKSFN RGEC | 222 |
| P1AE1001 heavy chain | QVQLVQSGAEVKKPGASVKVSCKASGYSFTGYYIHWVRQAPGQ SLEWMGRVIPNAGGTSYNQKFKGRVTLTVDKSISTAYMELSRL RSDDTAVYYCAREGIYWWGQGTTVTVSSASTKGPSVFPLAPSS KSTSGGTAALGCLVKDYFPEPVTVSWNSGALTSGVHTFPAVLQ SSGLYSLSSVVTVPSSSLGTQTYICNVNHKPSNTKVDKKVEPK SCDKTHTCPPCPAPEAAGGPSVFLFPPKPKDTLMISRTPEVTC VVVDVSHEDPEVKFNWYVDGVEVHNAKTKPREEQYNSTYRVVS VLTVLHQDWLNGKEYKCKVSNKALGAPIEKTISKAKGQPREPQ VYTLPPSRDELTKNQVSLTCLVKGFYPSDIAVEWESNGQPENN YKTTPPVLDSDGSFFLYSKLTVDKSRWQQGNVFSCSVMHEALH NHYTQKSLSLSPG | 223 |
| P1AE1001 light chain | DIVVTQTPLSLSVTPGQPASISCRSSQSLVHSNGNTFLHWYLQ KPGQSPQLLIYTVSNRFSGVPDRFSGSGSGTDFTLKISRVEAE DVGVYFCSQTTHVPWTFGGGTKVEIKRTVAAPSVFIFPPSDEQ LKSGTASVVCLLNNFYPREAKVQWKVDNALQSGNSQESVTEQD SKDSTYSLSSTLTLSKADYEKHKVYACEVTHQGLSSPVTKSFN RGEC | 224 |
| P1AE1002 heavy chain | QVQLVQSGAEVKKPGASVKVSCKASGYSFTGYYIHWVRQAPGK SLEWMGRVIPNAGGTSYNQKFKGRVTLTVDKSISTAYMELSRL RSDDTAVYYCAREGIYWWGQGTTVTVSSASTKGPSVFPLAPSS KSTSGGTAALGCLVKDYFPEPVTVSWNSGALTSGVHTFPAVLQ SSGLYSLSSVVTVPSSSLGTQTYICNVNHKPSNTKVDKKVEPK SCDKTHTCPPCPAPEAAGGPSVFLFPPKPKDTLMISRTPEVTC VVVDVSHEDPEVKFNWYVDGVEVHNAKTKPREEQYNSTYRVVS VLTVLHQDWLNGKEYKCKVSNKALGAPIEKTISKAKGQPREPQ VYTLPPSRDELTKNQVSLTCLVKGFYPSDIAVEWESNGQPENN YKTTPPVLDSDGSFFLYSKLTVDKSRWQQGNVFSCSVMHEALH NHYTQKSLSLSPG | 225 |
| P1AE1002 light chain | DIVMTQTPLSLSVTPGQPASISCRSSQSLVHSNGNTFLHWYLQ KPGQSPQLLIYTVSNRFSGVPDRFSGSGSGTDFTLKISRVEAE DVGVYFCSQTTHVPWTFGGGTKVEIKRTVAAPSVFIFPPSDEQ LKSGTASVVCLLNNFYPREAKVQWKVDNALQSGNSQESVTEQD SKDSTYSLSSTLTLSKADYEKHKVYACEVTHQGLSSPVTKSFN RGEC | 226 |
| P1AE1003 heavy chain | QVQLVQSGAEVKKPGASVKVSCKASGYSFTGYYIHWVRQAPGK SLEWMGRVIPNAGGTSYNQKFKGRVTLTVDKSISTAYMELSRL RSDDTAVYYCAREGIYWWGQGTTVTVSSASTKGPSVFPLAPSS KSTSGGTAALGCLVKDYFPEPVTVSWNSGALTSGVHTFPAVLQ SSGLYSLSSVVTVPSSSLGTQTYICNVNHKPSNTKVDKKVEPK SCDKTHTCPPCPAPEAAGGPSVFLFPPKPKDTLMISRTPEVTC VVVDVSHEDPEVKFNWYVDGVEVHNAKTKPREEQYNSTYRVVS VLTVLHQDWLNGKEYKCKVSNKALGAPIEKTISKAKGQPREPQ VYTLPPSRDELTKNQVSLTCLVKGFYPSDIAVEWESNGQPENN YKTTPPVLDSDGSFFLYSKLTVDKSRWQQGNVFSCSVMHEALH NHYTQKSLSLSPG | 227 |
| P1AE1003 light chain | DIVVTQTPLSLSVTPGQPASISCRSSQSLVHSNGNTFLHWYLQ KPGQSPQLLIYTVSNRFSGVPDRFSGSGSGTDFTLKISRVEAE DVGVYFCSQTTHVPWTFGGGTKVEIKRTVAAPSVFIFPPSDEQ LKSGTASVVCLLNNFYPREAKVQWKVDNALQSGNSQESVTEQD SKDSTYSLSSTLTLSKADYEKHKVYACEVTHQGLSSPVTKSFN RGEC | 228 |
| P1AE1004 heavy chain | QVQLVQSGAEVKKPGASVKVSCKASGYSFTGYYIHWVRQAPGK SLEWMGRVIPNAGGTSYNQKFKGRVTLTVDKSISTAYMELSRL RSDDTAVYYCAREGIYWWGQGTTVTVSSASTKGPSVFPLAPSS KSTSGGTAALGCLVKDYFPEPVTVSWNSGALTSGVHTFPAVLQ SSGLYSLSSVVTVPSSSLGTQTYICNVNHKPSNTKVDKKVEPK SCDKTHTCPPCPAPEAAGGPSVFLFPPKPKDTLMISRTPEVTC VVVDVSHEDPEVKFNWYVDGVEVHNAKTKPREEQYNSTYRVVS VLTVLHQDWLNGKEYKCKVSNKALGAPIEKTISKAKGQPREPQ | 229 |

TABLE 23-continued

Amino acid sequences of the humanized
CD40_IgG1_LALAPG antibodies

| Antibody | Sequence | Seq ID No |
|---|---|---|
| | VYTLPPSRDELTKNQVSLTCLVKGFYPSDIAVEWESNGQPENN YKTTPPVLDSDGSFFLYSKLTVDKSRWQQGNVFSCSVMHEALH NHYTQKSLSLSPG | |
| P1AE1004 light chain | DVVVTQTPLSLSVTPGQPASISCRSSQSLVHSNGNTFLHWYLQ KPGQSPQLLIYTVSNRFSGVPDRFSGSGSGTDFTLKISRVEAE DVGVYFCSQTTHVPWTFGGGTKVEIKRTVAAPSVFIFPPSDEQ LKSGTASVVCLLNNFYPREAKVQWKVDNALQSGNSQESVTEQD SKDSTYSLSSTLTLSKADYEKHKVYACEVTHQGLSSPVTKSFN RGEC | 230 |
| P1AE1005 heavy chain | QVQLVQSGAEVKKPGASVKVSCKASGYSFTGYYIHWVRQAPGK SLEWMGRVIPNAGGTSYNQKFKGRVTLTVDKSISTAYMELSRL RSDDTAVYYCAREGIYWWGQGTTVTVSSASTKGPSVFPLAPSS KSTSGGTAALGCLVKDYFPEPVTVSWNSGALTSGVHTFPAVLQ SSGLYSLSSVVTVPSSSLGTQTYICNVNHKPSNTKVDKKVEPK SCDKTHTCPPCPAPEAAGGPSVFLFPPKPKDTLMISRTPEVTC VVVDVSHEDPEVKFNWYVDGVEVHNAKTKPREEQYNSTYRVVS VLTVLHQDWLNGKEYKCKVSNKALGAPIEKTISKAKGQPREPQ VYTLPPSRDELTKNQVSLTCLVKGFYPSDIAVEWESNGQPENN YKTTPPVLDSDGSFFLYSKLTVDKSRWQQGNVFSCSVMHEALH NHYTQKSLSLSPG | 231 |
| P1AE1005 light chain | DVVVTQTPLSLSVTPGQPASISCRSSQSLVHSNGNTFLHWYLQ KPGQSPQLLIYTVSNRFSGVPDRFSGSGSGTDFTLKISRVEAE DVGVYFCSQTTHVPWTFGGGTKLEIKRTVAAPSVFIFPPSDEQ LKSGTASVVCLLNNFYPREAKVQWKVDNALQSGNSQESVTEQD SKDSTYSLSSTLTLSKADYEKHKVYACEVTHQGLSSPVTKSFN RGEC | 232 |
| P1AE1006 heavy chain | QVQLVQSGAEVKKPGASVKVSCKASGYSFTGYYIHWVRQAPGQ SLEWMGRVIPNAGGTSYNQKFKGRVTLTVDKSISTAYMELSRL RSDDTAVYYCAREGIYWWGHGTTVTVSSASTKGPSVFPLAPSS KSTSGGTAALGCLVKDYFPEPVTVSWNSGALTSGVHTFPAVLQ SSGLYSLSSVVTVPSSSLGTQTYICNVNHKPSNTKVDKKVEPK SCDKTHTCPPCPAPEAAGGPSVFLFPPKPKDTLMISRTPEVTC VVVDVSHEDPEVKFNWYVDGVEVHNAKTKPREEQYNSTYRVVS VLTVLHQDWLNGKEYKCKVSNKALGAPIEKTISKAKGQPREPQ VYTLPPSRDELTKNQVSLTCLVKGFYPSDIAVEWESNGQPENN YKTTPPVLDSDGSFFLYSKLTVDKSRWQQGNVFSCSVMHEALH NHYTQKSLSLSPG | 233 |
| P1AE1006 light chain | DIVVTQTPLSLSVTPGQPASISCRSSQSLVHSNGNTFLHWYLQ KPGQSPQLLIYTVSNRFSGVPDRFSGSGSGTDFTLKISRVEAE DVGVYFCSQTTHVPWTFGGGTKVEIKRTVAAPSVFIFPPSDEQ LKSGTASVVCLLNNFYPREAKVQWKVDNALQSGNSQESVTEQD SKDSTYSLSSTLTLSKADYEKHKVYACEVTHQGLSSPVTKSFN RGEC | 234 |
| P1AE1007 heavy chain | QVQLVQSGAEVKKPGASVKVSCKASGYSFTGYYIHWVRQAPGQ SLEWMGRVIPNAGGTSYNQKFKGRVTLSVDKSISTAYMELSRL RSDDTAVYYCAREGIYWWGQGTTVTVSSASTKGPSVFPLAPSS KSTSGGTAALGCLVKDYFPEPVTVSWNSGALTSGVHTFPAVLQ SSGLYSLSSVVTVPSSSLGTQTYICNVNHKPSNTKVDKKVEPK SCDKTHTCPPCPAPEAAGGPSVFLFPPKPKDTLMISRTPEVTC VVVDVSHEDPEVKFNWYVDGVEVHNAKTKPREEQYNSTYRVVS VLTVLHQDWLNGKEYKCKVSNKALGAPIEKTISKAKGQPREPQ VYTLPPSRDELTKNQVSLTCLVKGFYPSDIAVEWESNGQPENN YKTTPPVLDSDGSFFLYSKLTVDKSRWQQGNVFSCSVMHEALH NHYTQKSLSLSPG | 235 |
| P1AE1007 light chain | DIVVTQTPLSLSVTPGQPASISCRSSQSLVHSNGNTFLHWYLQ KPGQSPQLLIYTVSNRFSGVPDRFSGSGSGTDFTLKISRVEAE DVGVYFCSQTTHVPWTFGGGTKVEIKRTVAAPSVFIFPPSDEQ LKSGTASVVCLLNNFYPREAKVQWKVDNALQSGNSQESVTEQD SKDSTYSLSSTLTLSKADYEKHKVYACEVTHQGLSSPVTKSFN RGEC | 236 |
| P1AE1125 heavy chain | EVQLLESGGGLVQPGGSLRLSCAASGYSFTGYYMHWVRQAPGK GLEWVGRVIPNAGGTSYNQKFKGRFTISVDNSKNTAYLQMNSL RAEDTAVYYCAREGIYWWGQGTTVTVSSASTKGPSVFPLAPSS KSTSGGTAALGCLVKDYFPEPVTVSWNSGALTSGVHTFPAVLQ SSGLYSLSSVVTVPSSSLGTQTYICNVNHKPSNTKVDKKVEPK SCDKTHTCPPCPAPEAAGGPSVFLFPPKPKDTLMISRTPEVTC | 237 |

TABLE 23-continued

Amino acid sequences of the humanized CD40 IgG1 LALAPG antibodies

| Antibody | Sequence | Seq ID No |
|---|---|---|
| | VVVDVSHEDPEVKFNWYVDGVEVHNAKTKPREEQYNSTYRVVS<br>VLTVLHQDWLNGKEYKCKVSNKALGAPIEKTISKAKGQPREPQ<br>VYTLPPSRDELTKNQVSLTCLVKGFYPSDIAVEWESNGQPENN<br>YKTTPPVLDSDGSFFLYSKLTVDKSRWQQGNVFSCSVMHEALH<br>NHYTQKSLSLSPG | |
| P1AE1125<br>light chain | DIQMTQSPSSLSASVGDRVTITCRASQSLVHSNGNTFLHWYQQ<br>KPGKAPKLLIYTVSNRFSGVPSRFSGSGSGTDFTLTISSLQPE<br>DFATYFCSQTTHVPWTFGGGTKVEIKRTVAAPSVFIFPPSDEQ<br>LKSGTASVVCLLNNFYPREAKVQWKVDNALQSGNSQESVTEQD<br>SKDSTYSLSSTLTLSKADYEKHKVYACEVTHQGLSSPVTKSFN<br>RGEC | 238 |
| P1AE1126<br>heavy chain | EVQLLESGGGLVQPGGSLRLSCAASGYSFTGYYMHWVRQAPGK<br>GLEWVGRVIPNAGGTSYNQKFKGRFTISVDNSKNTAYLQMNSL<br>RAEDTAVYYCAREGIYWWGQGTTVTVSSASTKGPSVFPLAPSS<br>KSTSGGTAALGCLVKDYFPEPVTVSWNSGALTSGVHTFPAVLQ<br>SSGLYSLSSVVTVPSSSLGTQTYICNVNHKPSNTKVDKKVEPK<br>SCDKTHTCPPCPAPEAAGGPSVFLFPPKPKDTLMISRTPEVTC<br>VVVDVSHEDPEVKFNWYVDGVEVHNAKTKPREEQYNSTYRVVS<br>VLTVLHQDWLNGKEYKCKVSNKALGAPIEKTISKAKGQPREPQ<br>VYTLPPSRDELTKNQVSLTCLVKGFYPSDIAVEWESNGQPENN<br>YKTTPPVLDSDGSFFLYSKLTVDKSRWQQGNVFSCSVMHEALH<br>NHYTQKSLSLSPG | 239 |
| P1AE1126<br>light chain | DIQMTQSPSSLSASVGDRVTITCRSSQSIVHSNGNTFLHWYQQ<br>KPGKAPKLLIYTVSNRFSGVPSRFSGSGSGTDFTLTISSLQPE<br>DFATYFCSQTTHVPWTFGGGTKVEIKRTVAAPSVFIFPPSDEQ<br>LKSGTASVVCLLNNFYPREAKVQWKVDNALQSGNSQESVTEQD<br>SKDSTYSLSSTLTLSKADYEKHKVYACEVTHQGLSSPVTKSFN<br>RGEC | 240 |
| P1AE1135<br>heavy chain | EVQLLESGGGLVQPGGSLRLSCAASGYSFTGYYIHWVRQAPGK<br>GLEWVGRVIPNAGGTSYNQKVKGRFTISVDNSKNTAYLQMNSL<br>RAEDTAVYYCAREGIYWWGQGTTVTVSSASTKGPSVFPLAPSS<br>KSTSGGTAALGCLVKDYFPEPVTVSWNSGALTSGVHTFPAVLQ<br>SSGLYSLSSVVTVPSSSLGTQTYICNVNHKPSNTKVDKKVEPK<br>SCDKTHTCPPCPAPEAAGGPSVFLFPPKPKDTLMISRTPEVTC<br>VVVDVSHEDPEVKFNWYVDGVEVHNAKTKPREEQYNSTYRVVS<br>VLTVLHQDWLNGKEYKCKVSNKALGAPIEKTISKAKGQPREPQ<br>VYTLPPSRDELTKNQVSLTCLVKGFYPSDIAVEWESNGQPENN<br>YKTTPPVLDSDGSFFLYSKLTVDKSRWQQGNVFSCSVMHEALH<br>NHYTQKSLSLSPG | 241 |
| P1AE1135<br>light chain | DIQMTQSPSSLSASVGDRVTITCRSSQSIVHSNGNTFLHWYQQ<br>KPGKAPKLLIYTVSNRFSGVPSRFSGSGSGTDFTLTISSLQPE<br>DFATYFCSQTTHVPWTFGGGTKVEIKRTVAAPSVFIFPPSDEQ<br>LKSGTASVVCLLNNFYPREAKVQWKVDNALQSGNSQESVTEQD<br>SKDSTYSLSSTLTLSKADYEKHKVYACEVTHQGLSSPVTKSFN<br>RGEC | 242 |

4.2.5 Production of the New Humanized CD40 Antibodies in huIgG1_LALA_PG Format The antibodies were expressed by transient transfection of HEK293-F cells grown in suspension with expression vectors encoding the different peptide chains. Transfection into HEK293-F cells (Invitrogen, USA) was performed according to the cell supplier's instructions using Maxiprep (Qiagen, Germany) preparations of the antibody vectors. F17 based medium (Invitrogen, USA), PEIPRO® (Polyscience Europe GmbH) and an initial cell density of 1-2 million viable cells/ml in serum free FREESTYLE™ 293 expression medium (Invitrogen). Cell culture supernatants were harvested after 7 days of cultivation in shake flasks or stirred fermenters by centrifugation at 14000 g for 30 minutes and filtered through a 0.22 µm filter.

The antibodies were purified from cell culture supernatants by affinity chromatography using MabSelectSure-SEPHAROSE™ (GE Healthcare, Sweden) chromatography. Briefly, sterile filtered cell culture supernatants were captured on a MabSelect SuRe resin equilibrated with PBS buffer (10 mM $Na_2HPO_4$, 1 mM $KH_2PO_4$, 137 mM NaCl and 2.7 mM KCl, pH 7.4), washed with equilibration buffer and eluted with 25 mM citrate, pH 3.0. After neutralization with 1 M Tris pH 9.0, aggregated protein was separated from monomeric antibody species by size exclusion chromatography (SUPERDEX®: 200. GE Healthcare) in 20 mM histidine. 140) mM NaCl, pH 6.0. Monomeric protein fractions were pooled, concentrated if required using e.g. a MILLIPORE Amicon Ultra (30KD MWCO) centrifugal concentrator and stored at −80° C. Sample aliquots were used for subsequent analytical characterization e.g. by CE-SDS, size exclusion chromatography, mass spectrometry and endotoxin determination.

The production yield for the different humanized CD40 antibodies is shown in Table 21 as titer values calculated from the yield after preparative affinity chromatography using MabSelectSure-Sepharose™ chromatography.

Purity and molecular weight of the molecule after the final purification step were analyzed by CE-SDS analyses in the presence and absence of a reducing agent. The Caliper LABCHIP® GXII system (Caliper Lifescience) was used according to the manufacturer's instruction.

The aggregate content of the molecule was analyzed using a TSKGEL® G3000 SW XL analytical size-exclusion column (Tosoh) in 25 mM potassium phosphate. 125 mM sodium chloride. 200 mM L-arginine monohydrochloride. 0.02% (w/v) $NaN_3$, pH 6.7 running buffer at 25° C.

For direct comparison of all antibodies the thermal stability was monitored by Static Light Scattering (SLS) and by measuring the intrinsic protein fluorescence in response to applied temperature stress. 30 µg of filtered protein sample with a protein concentration of 1 mg/ml was applied in duplicate to an OPTIM® 2 instrument (Avacta Analytical Ltd). The temperature was ramped from 25 to 85° C., at 0.1° C./min, with the radius and total scattering intensity being collected. For determination of intrinsic protein fluorescence the sample was excited at 266 nm and emission was collected between 275 nm and 460 nm. For all antibodies the aggregation temperature (Tagg) was between 64 and 69° C., and is provided in Table 24 or Table 25 below:

The production yield for the humanized CD40 antibodies with the different frameworks is shown in Table 24 or Table 25 below.

TABLE 24

Production titer, humanness and aggregation temperature of humanized CD40 antibodies based on acceptor framework 2

| Antibody | VH/VL | Titer [µg/ml] | humanness (VH/VL in %) | Tagg |
|---|---|---|---|---|
| P1AD4470 | control | 140 | 77.6/78 | 68 |
| P1AE0400 | VL2a/VH2a | 219 | 77.6/78 | 69 |
| P1AE0401 | VL2a/VH2b | 162 | 76.5/78 | 69 |
| P1AE0402 | VL2a/VH2c | 196 | 77.6/78 | 69 |
| P1AE0403 | VL2a/VH2d | 137 | 80.6/78 | 67 |
| P1AE0404 | VL2b/VH2a | 165 | 77.6/76 | 69 |
| P1AE0405 | VL2b/VH2b | 128 | 76.5/76 | 69 |
| P1AE0406 | VL2b/VH2c | 154 | 77.6/76 | 69 |
| P1AE0407 | VL2b/VH2d | 102 | 80.6/76 | 67 |

TABLE 25

Prouction titer, humanness and aggregation temperature of humanized CD40 antibodies based on acceptor framework 1

| Antibody | VH/VL | Titer [µg/ml] | humanness (VH/VL in %) | Tagg |
|---|---|---|---|---|
| P1AE0816 | control | 8.5 | 84.7/84 | 64 |
| P1AE0817 | VH1a/VL1a | 62 | 86.7/87 | 67 |
| P1AE0818 | VH1c/VL1c | 47 | 86.7/85 | 66 |
| P1AE0819 | VH1d/VL1d | 90 | 85.7/85 | 67 |
| P1AE0993 | VH1a/VL1c | 34 | 86.7/85 | 67 |
| P1AE0996 | VH1a/VL1d | 16 | 86.7/85 | 67 |
| P1AE0997 | VH1c/VL1a | 44 | 86.7/87 | 66 |
| P1AE0998 | VH1c/VL1d | 24 | 86.7/85 | 66 |
| P1AE0999 | VH1d/VL1a | 34 | 85.7/87 | 67 |
| P1AE1000 | VH1d/VL1c | 16 | 85.7/85 | 66 |
| P1AE1001 | VH1a/VL1b | 34 | 86.7/86 | 65 |
| P1AE1002 | VH1b/VL1a | 46 | 85.7/87 | 67 |
| P1AE1003 | VH1b/VL1b | 49 | 85.7/86 | 66 |
| P1AE1004 | VH1b/VL1c | 60 | 85.7/85 | 67 |
| P1AE1005 | VH1b/VL1d | 7 | 85.7/85 | 65 |
| P1AE1006 | VH1c/VL1b | 24 | 86.7/86 | 65 |
| P1AE1007 | VH1d/VL1b | 34 | 85.7/86 | 67 |

4.2.6 Generation of Recombinant Human and Cynomolgus Monkey CD40 Extracellular Domain Protein Following constructs were cloned and expressed by transient expression in HEK293 cells:
1) Human CD40 extracellular domain (amino acids 21-193 of SEQ ID NO:1, NCBI accession number NP_001241) with C-terminal His-AVITAG™ tag (SEQ ID NO:266)
2) Cynomolgus monkey (*Macaca fascicularis*) CD40 extracellular domain (amino acids 21-193, cynomolgus CD40 extracellular domain sequence was taken from Roche cynomolgus cDNA database, unpublished data) with C-terminal His-AVITAG™ tag (SEQ ID NO:267)

CD40 extracellular domain antigens for binding analysis were generated by gene synthesis (Eurofins Genomics GmbH service, Germany), cloned via unique restriction sites into Roche's in house expression vector using standard cloning procedures. Cloning of all constructs was verified by sequencing. All antigens were expressed under the control of the CMV-promoter. For transient expression of the CD40 extracellular domain constructs, suspension-adapted HEK293-F cells (Life Technologies, USA) were transfected with the respective plasmids: In general, IL of HEK293-F cells at about $2 \times 10^6$ cells/ml were transfected with a total of 500 µg plasmid DNA complexed by the PEIPRO®: Transfection Reagent (Polysciences Europe GmbH, Germany) according to manufacturer's instructions. After transfection, HEK293-F cells were incubated for 6 days. The cells were subsequently harvested by centrifugation and the protein-containing supernatant was filtered using a 0.22 µm vacuum filtration system (Millipore). The His-AVITAG™ tagged proteins were purified by IMAC affinity chromatography using complete-His-Tag resin (Roche Diagnostics). After washing with 50 mM $Na_2PO_4$, 300 mM NaCl, pH 8.0, His-AVITAG™ fusion proteins were eluted using washing buffer supplemented with 500 mM Imidazol at pH 7.0. Aggregated protein was separated from monomeric fusion proteins by size exclusion chromatography (SUPERDEX® 75, GE Healthcare) in 20 mM Tris, 150 mM NaCl, pH 7.4. Monomeric protein fractions were pooled, concentrated if required using e.g. a MILLIPORE Amicon Ultra (10KD MWCO) centrifugal concentrator and stored at −80° C. Sample aliquots were used for subsequent analytical characterization e.g. by CE-SDS, size exclusion chromatography and mass spectrometry.

Biotinylation of CD40 Extracellular Domain:

Enzymatic site specific biotinylation of human or cynomolgus CD40 extracellular domain constructs containing a C-terminal AVITAG™ was performed by using the BirA biotin-protein ligase kit (Avidity LLC. USA) according to manufactures instruction. Briefly. 1/10 volume of BiomixA (10× concentration: 0.5M bicine buffer, pH 8.3) and BiomixB (10× concentration: 100 mM ATP. 100 mM MgOAc, 500 µM d-biotin) was added to AVITAG™ containing protein followed by addition of 2.5 μg BirA ligase per 10 nmol protein. The reaction mixture was incubated at 30° C., for 1h and purified by size exclusion chromatography on a Superdex75 prep grade prepacked HiLoad column (GE Healthcare. Sweden).

4.2.7 Human/Cynomolgus CD40 Binding Surface Plasmon Resonance Spectroscopy Assay Around 12000 resonance units (RU) of the capturing system (10 μg/ml goat anti human F(ab')$_2$; Order Code: 28958325; GE Healthcare Bio-Sciences AB. Sweden) were coupled on a CM5 chip (GE Healthcare BR-1005-30) at pH 5.0 by using an amine coupling kit supplied by the GE Healthcare. The sample and system buffer was PBS-T (10 mM phosphate buffered saline including 0.05% Tween20) pH 7.4. The flow cell was set to 25° C.—and the sample block set to 12° C.—and primed with running buffer twice. The antibody was captured by injecting a 50 nM solution for 30 sec at a flow of 5 μl/min. Association was measured by injection of human CD40 extra cellular domain or cynomolgus monkey CD40 extracellular domain in various concentrations in solution for 300 sec at a flow of 30 μl/min starting with 300 nM in 1:3 dilutions. The dissociation phase was monitored for up to 1200 sec and triggered by switching from the sample solution to running buffer. The surface was regenerated by 60 sec washing with a Glycine pH 2. 1 solution at a flow rate of 30 μl/min. Bulk refractive index differences were corrected by subtracting the response obtained from a goat anti human F(ab')$_2$ surface. Blank injections are also subtracted (=double referencing). For calculation of apparent K$_D$ and other kinetic parameters the Langmuir 1:1 model was used. The apparent Kd was calculated using the BIACORE® B4000 evaluation software (version 1.1).

4.2.8 Cellular Binding Assay for Characterization of CD40-Specific Humanized Antibodies CD40 positive cells (Raji cells) were detached from the culture bottle using Trypsin and were counted using a Casy cell counter. After pelleting at 4° C., the cells were resuspended in FACS Buffer (2.5% FCS in PBS), adjusted to 2.0E+06 cells/mL, and dispensed to 96-well PP V-bottom-plates (25 μL/well=5.0E+04Zellen/well). 30) The CD40 specific antibodies were adjusted to 20 μg/mL in FACS buffer, resulting in a final concentration of 10 μg/mL. 20 μl were added to 25 μl cell suspension and incubated for 1 h at 4° C. The cells were then washed twice in FACS buffer. After washing, the cells were resuspended in 50 μL FACS-buffer containing secondary antibody (<huIgG>-Alexa488, c=10 μg/mL) and incubated 1h at 4° C. The cells were then washed twice in FACS buffer and resuspended in 70 μl/well FACS buffer for measurement using a FACS Canto (BD. Pharmingen).

In Table 26 the affinity of the humanized CD40 antibodies (measured by BIACORE®) and the cellular binding to CD40 expressing cells (Raji cells) is shown.

TABLE 26

Affinity and cellular binding of humanized CD40 antibodies to CD40 expressing cells

| ID | VH/VL | Affinity [nM] | Ka (1/Ms) | Kd (1/s) | EC$_{50}$ [μg/ml] cellular binding (Raji) |
|---|---|---|---|---|---|
| P1AD4470 | control | 4.6 | 1.69E+06 | 7.81E-03 | 0.09 |
| P1AE0400 | VL2a/VH2a | 4.2 | 1.68E+06 | 6.99E-03 | 0.12 |

TABLE 26-continued

Affinity and cellular binding of humanized CD40 antibodies to CD40 expressing cells

| ID | VH/VL | Affinity [nM] | Ka (1/Ms) | Kd (1/s) | EC$_{50}$ [μg/ml] cellular binding (Raji) |
|---|---|---|---|---|---|
| P1AE0401 | VL2a/VH2b | 4.6 | 1.69E+06 | 7.87E-03 | 0.13 |
| P1AE0402 | VL2a/VH2c | 4.2 | 1.67E+06 | 7.09E-03 | 0.13 |
| P1AE0403 | VL2a/VH2d | 29 | 1.40E+06 | 4.07E-02 | 0.12 |
| P1AE0404 | VL2b/VH2a | 4.2 | 1.63E+06 | 6.93E-03 | 0.11 |
| P1AE0405 | VL2b/VH2b | 5.1 | 1.61E+06 | 8.14E-03 | 0.09 |
| P1AE0406 | VL2b/VH2c | 4.2 | 1.67E+06 | 7.09E-03 | 0.09 |
| P1AE0407 | VL2b/VH2d | 30 | 1.19E+06 | 3.55E-02 | 0.12 |
| P1AE0816 | control | 8.7 | 2.53E+06 | 2.19E-02 | 0.09 |
| P1AE0817 | VH1a/VL1a | 2.5 | 2.40E+06 | 5.93E-03 | 0.09 |
| P1AE0818 | VH1c/VL1c | 3.2 | 2.63E+06 | 8.47E-03 | 0.14 |
| P1AE0819 | VH1d/VL1d | 3.4 | 2.59E+06 | 8.77E-03 | 0.11 |
| P1AE0993 | VH1a/VL1c | 3.4 | 2.68E+06 | 8.98E-03 | 0.13 |
| P1AE0996 | VH1a/VL1d | 3.5 | 2.59E+06 | 9.08E-03 | 0.12 |
| P1AE0997 | VH1c/VL1a | 2.3 | 2.59E+06 | 6.03E-03 | 0.12 |
| P1AE0998 | VH1c/VL1d | 3.3 | 2.70E+06 | 8.96E-03 | 0.12 |
| P1AE0999 | VH1d/VL1a | 2.4 | 2.45E+06 | 5.92E-03 | 0.15 |
| P1AE1000 | VH1d/VL1c | 3.2 | 2.68E+06 | 8.62E-03 | 0.14 |
| P1AE1001 | VH1a/VL1b | 2.7 | 2.56E+06 | 6.81E-03 | 0.08 |
| P1AE1002 | VH1b/VL1a | 2.2 | 2.54E+06 | 5.57E-03 | 0.13 |
| P1AE1003 | VH1b/VL1b | 2.5 | 2.46E+06 | 6.06E-03 | 0.13 |
| P1AE1004 | VH1b/VL1c | 3 | 2.63E+06 | 7.95E-03 | 0.14 |
| P1AE1005 | VH1b/VL1d | 3.2 | 2.58E+06 | 8.16E-03 | 0.11 |
| P1AE1006 | VH1c/VL1b | 2.6 | 2.53E+06 | 6.51E-03 | 0.14 |
| P1AE1007 | VH1d/VL1b | 2.7 | 2.50E+06 | 6.62E-03 | 0.12 |

4.2.9 Antibody Characterization by UHR-ESI-QTOF Mass Spectrometry

The samples were desalted by HPLC on a SEPHADEX® G25 5×250 mm column (Amersham Biosciences, Freiburg, Germany) using 40% acetonitrile with 2% formic acid (v/v). The total mass was determined by UHR-ESI-QTOF MS on a maXis 4G UHR-QTOF MS system (Bruker Daltonik, Bremen, Germany) equipped with a TRIVERSA NANO-MATE® source (Advion, Ithaca, NY). Data acquisition was done at 900-4000 m/z (ISCID: 0.0 eV). The raw mass spectra were evaluated and transformed into individual relative molar masses using an in-house developed software tool.

4.2.10 Thermal Stability Evaluation of Antibodies

Samples are prepared at a concentration of 1 mg/mL in 20 mM Histidine/Histidine chloride, 140 mM NaCl, pH 6.0, transferred into an optical 384-well plate by centrifugation through a 0.4 μm filter plate and covered with paraffin oil. The hydrodynamic radius is measured repeatedly by dynamic light scattering on a DYNAPRO® Plate Reader (Wyatt) while the samples are heated with a rate of 0.05° C./min from 25° C., to 80° C. Alternatively, samples were transferred into a 10 μL micro-cuvette array and static light scattering data as well as fluorescence data upon excitation with a 266 nm laser were recorded with an Optim1000 instrument (Avacta Inc.), while they were heated at a rate of 0.1° C./min from 25° C., to 90° C. The aggregation onset temperature is defined as the temperature at which the hydrodynamic radius (DLS) or the scattered light intensity (Optim1000) starts to increase. The melting temperature is defined as the inflection point in a graph showing fluorescence intensity vs. wavelength.

Example 5

Generation and Production of Bispecific Constructs with New Humanized CD40 Antibody Variants

5.1 Generation of Bispecific Antigen Binding Molecules Targeting CD40 and Fibroblast Activation Protein (FAP)

The cDNAs encoding a VH domain and a VL domain as described in Example 4 were cloned in frame with the corresponding constant heavy or light chains of human IgG1 in suitable expression plasmids. Expression of heavy and light chain is driven by a chimeric MPSV promoter consisting of the MPSV core promoter and a CMV enhancer element. The expression cassette also contains a synthetic polyA signal at the 3' end of the cDNAs. In addition the plasmid vectors harbor an origin of replication (EBV oriP) for episomal maintenance of the plasmids.

Figure 1F:
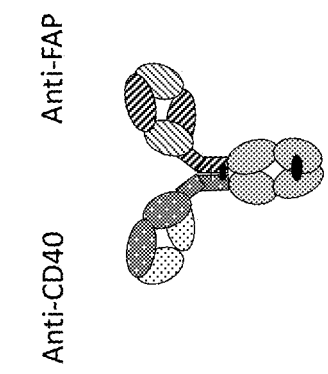
Figure 1B:
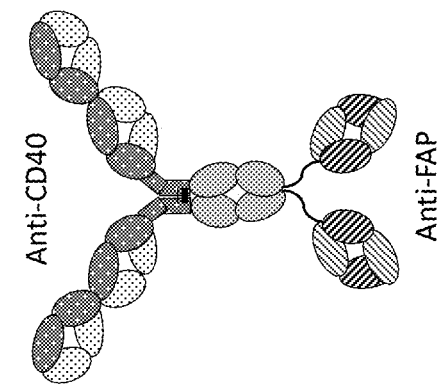
Figure 1E:
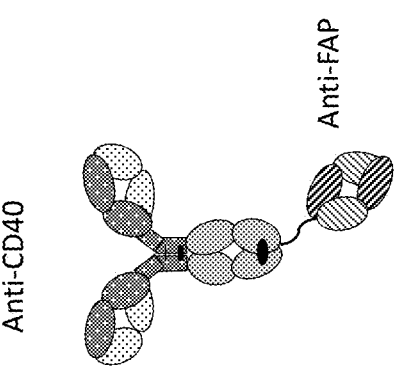
FIG. 1E shows a schematic representation of a bispecific CD40-FAP antibody in the 2+1 10) format consisting of two CD40 binding Fab domains combined with one FAP binding Fab domains fused at the C-terminus of one of the heavy chains (bivalent for CD40) and monovalent for FAP). The black point symbolizes knob-into-hole mutations.
Figure 1A:
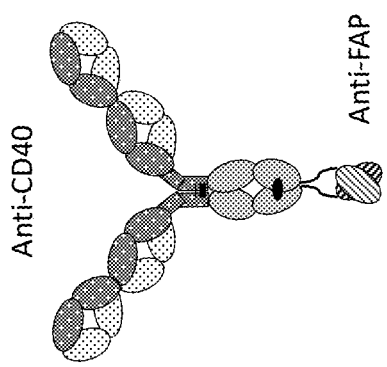
Figure 1D:
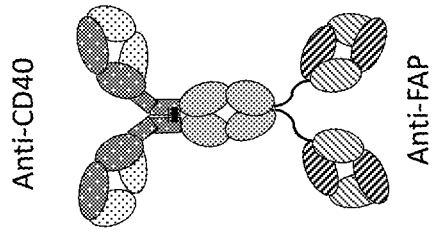

In analogy to Example 1, different bispecific CD40-FAP antibodies are prepared in 4+1 format consisting of four CD40 binding moieties combined with one FAP binding moiety at the C-terminus of an Fc (FIG. 1A) or in 2+1 and 2+2 formats consisting of two CD40 binding moieties combined with either one FAP binding moiety at the C-terminus of an Fc (FIG. 1C and FIG. 1E) or two FAP binding moieties at the C-terminus of an Fc (FIG. 1D). In addition, a bispecific antibody consisting of one CD40 binding moiety combined with one FAP binding moiety is prepared (FIG. 1F). The generation and preparation of FAP binders 28H1 and 4B9 is described in WO 2012/020006 A2, which is incorporated herein by reference. To generate the 4+1 and the 2+1 molecules the knob-into-hole technology is used to achieve heterodimerization. The S354C/T366W mutations are introduced in the first heavy chain HC1 (Fc knob heavy chain) and the γ349C/T366S/L368A/γ407V mutations are introduced in the second heavy chain HC2 (Fc hole heavy chain). In the 2+2 molecule the CrossMAb technology as described in WO 2010/145792 A1 ensures correct light chain pairing. Independent of the bispecific format, in all cases an effector silent Fc (P329G; L234, 234A) is used to abrogate binding to Fcγ receptors according to the method described in WO 2012/130831 A1. Sequences of the bispecific molecules are shown in Table 27.

All genes are transiently expressed under control of a chimeric MPSV promoter consisting of the MPSV core promoter combined with the CMV promoter enhancer fragment. The expression vector also contains the oriP region for episomal replication in EBNA (Epstein Barr Virus Nuclear Antigen) containing host cells.

TABLE 27

Amino acid sequences of the bispecific antigen binding molecules

| Construct | Sequence | Seq ID No |
|---|---|---|
| CD40 (hVH3/hVK2) × FAP (4B9) (4 + 1) with C-terminal VH/VL | | |
| hVH3_CD40 VHCH1-VHCH1-Fc knob_PGLALA - 4B9 VH | QVQLVQSGAEVKKPGASVKVSCKASGYSFTGYYIHWVRQAPGQ GLEWIGRVIPNAGGTSYNQKFKGRVTSTVDTSISTAYMELSRL RSDDTVVYYCAREGIYWWGQGTTVTVSSASTKGPSVFPLAPSS KSTSGGTAALGCLVKDYFPEPVTVSWNSGALTSGVHTFPAVLQ SSGLYSLSSVVTVPSSSLGTQTYICNVNHKPSNTKVDKKVEPK SCDGGGGSGGGGSQVQLVQSGAEVKKPGASVKVSCKASGYSFT GYYIHWVRQAPGQGLEWIGRVIPNAGGTSYNQKFKGRVTSTVD TSISTAYMELSRLRSDDTVVYYCAREGIYWWGQGTTVTVSSAS TKGPSVFPLAPSSKSTSGGTAALGCLVKDYFPEPVTVSWNSGA LTSGVHTFPAVLQSSGLYSLSSVVTVPSSSLGTQTYICNVNHK PSNTKVDKKVEPKSCDKTHTCPPCPAPEAAGGPSVFLFPPKPK DTLMISRTPEVTCVVVDVSHEDPEVKFNWYVDGVEVHNAKTKP REEQYNSTYRVVSVLTVLHQDWLNGKEYKCKVSNKALGAPIEK TISKAKGQPREPQVYTLPPCRDELTKNQVSLWCLVKGFYPSDI AVEWESNGQPENNYKTTPPVLDSDGSFFLYSKLTVDKSRWQQG NVFSCSVMHEALHNHYTQKSLSLSPGGGGSGGGGSGGGGSGG GGSEVQLLESGGGLVQPGGSLRLSCAASGFTFSSYAMSWVRQA PGKGLEWVSAIIGSGASTYYADSVKGRFTISRDNSKNTLYLQM NSLRAEDTAVYYCAKGWFGGFNYWGQGTLVTVSS | 131 |
| hVH3_CD40 VHCH1-VHCH1-Fc hole_PGLALA-4B9 VL | QVQLVQSGAEVKKPGASVKVSCKASGYSFTGYYIHWVRQAPGQ GLEWIGRVIPNAGGTSYNQKFKGRVTSTVDTSISTAYMELSRL RSDDTVVYYCAREGIYWWGQGTTVTVSSASTKGPSVFPLAPSS KSTSGGTAALGCLVKDYFPEPVTVSWNSGALTSGVHTFPAVLQ SSGLYSLSSVVTVPSSSLGTQTYICNVNHKPSNTKVDKKVEPK SCDGGGGSGGGGSQVQLVQSGAEVKKPGASVKVSCKASGYSFT GYYIHWVRQAPGQGLEWIGRVIPNAGGTSYNQKFKGRVTSTVD TSISTAYMELSRLRSDDTVVYYCAREGIYWWGQGTTVTVSSAS TKGPSVFPLAPSSKSTSGGTAALGCLVKDYFPEPVTVSWNSGA LTSGVHTFPAVLQSSGLYSLSSVVTVPSSSLGTQTYICNVNHK PSNTKVDKKVEPKSCDKTHTCPPCPAPEAAGGPSVFLFPPKPK DTLMISRTPEVTCVVVDVSHEDPEVKFNWYVDGVEVHNAKTKP REEQYNSTYRVVSVLTVLHQDWLNGKEYKCKVSNKALGAPIEK TISKAKGQPREPQVCTLPPSRDELTKNQVSLSCAVKGFYPSDI AVEWESNGQPENNYKTTPPVLDSDGSFFLVSKLTVDKSRWQQG NVFSCSVMHEALHNHYTQKSLSLSPGGGGSGGGGSGGGGSGG GGSEIVLTQSPGTLSLSPGERATLSCRASQSVISSYLAWYQQK PGQAPRLLINVGSRRATGIPDRFSGSGSGTDFTLTISRLEPED FAVYYCQQGIMLPPTFGQGTKVEIK | 132 |

TABLE 27-continued

Amino acid sequences of the bispecific antigen binding molecules

| Construct | Sequence | Seq ID No |
|---|---|---|
| hVK2_CD40 light chain | DVVMTQSPLSLPVTLGQPASISCRSSQSLVHSNGNTFLHWYQQ RPGQSPRLLIYTVSNRFSGVPDRFSGSGSGTDFTLKISRVEAE DVGVYYCSQTTHVPWTFGQGTKVEIKRTVAAPSVFIFPPSDEQ LKSGTASVVCLLNNFYPREAKVQWKVDNALQSGNSQESVTEQD SKDSTYSLSSTLTLSKADYEKHKVYACEVTHQGLSSPVTKSFN RGEC | 133 |

CD40 (hVH3/hVK2) × FAP (4B9) (2 + 1) with C-terminal VH/VL

| Construct | Sequence | Seq ID No |
|---|---|---|
| hVH3_CD40 VHCH1- Fc knob_PGLALA - 4B9 VH | QVQLVQSGAEVKKPGASVKVSCKASGYSFTGYYIHWVRQAPGQ GLEWIGRVIPNAGGTSYNQKFKGRVTSTVDTSISTAYMELSRL RSDDTVVYYCAREGIYWWGQGTTVTVSSASTKGPSVFPLAPSS KSTSGGTAALGCLVKDYFPEPVTVSWNSGALTSGVHTFPAVLQ SSGLYSLSSVVTVPSSSLGTQTYICNVNHKPSNTKVDKKVEPK SCDKTHTCPPCPAPEAAGGPSVFLFPPKPKDTLMISRTPEVTC VVVDVSHEDPEVKFNWYVDGVEVHNAKTKPREEQYNSTYRVVS VLTVLHQDWLNGKEYKCKVSNKALGAPIEKTISKAKGQPREPQ VYTLPPCRDELTKNQVSLWCLVKGFYPSDIAVEWESNGQPENN YKTTPPVLDSDGSFFLYSKLTVDKSRWQQGNVFSCSVMHEALH NHYTQKSLSLSPGGGGSGGGGSGGGGSGGGGSEVQLLESGGG LVQPGGSLRLSCAASGFTFSSYAMSWVRQAPGKGLEWVSAIIG SGASTYYADSVKGRFTISRDNSKNTLYLQMNSLRAEDTAVYYC AKGWFGGFNYWGQGTLVTVSS | 134 |
| hVH3_CD40 VHCH1- Fc hole_PGLALA - 4B9 VL | QVQLVQSGAEVKKPGASVKVSCKASGYSFTGYYIHWVRQAPGQ GLEWIGRVIPNAGGTSYNQKFKGRVTSTVDTSISTAYMELSRL RSDDTVVYYCAREGIYWWGQGTTVTVSSASTKGPSVFPLAPSS KSTSGGTAALGCLVKDYFPEPVTVSWNSGALTSGVHTFPAVLQ SSGLYSLSSVVTVPSSSLGTQTYICNVNHKPSNTKVDKKVEPK SCDKTHTCPPCPAPEAAGGPSVFLFPPKPKDTLMISRTPEVTC VVVDVSHEDPEVKFNWYVDGVEVHNAKTKPREEQYNSTYRVVS VLTVLHQDWLNGKEYKCKVSNKALGAPIEKTISKAKGQPREPQ VCTLPPSRDELTKNQVSLSCAVKGFYPSDIAVEWESNGQPENN YKTTPPVLDSDGSFFLVSKLTVDKSRWQQGNVFSCSVMHEALH NHYTQKSLSLSPGGGGSGGGGSGGGGSGGGGSEIVLTQSPGT LSLSPGERATLSCRASQSVTSSYLAWYQQKPGQAPRLLINVGS RRATGIPDRFSGSGSGTDFTLTISRLEPEDFAVYYCQQGIMLP PTFGQGTKVEIK | 135 |
| hVK2_CD40 light chain | DVVMTQSPLSLPVTLGQPASISCRSSQSLVHSNGNTFLHWYQQ RPGQSPRLLIYTVSNRFSGVPDRFSGSGSGTDFTLKISRVEAE DVGVYYCSQTTHVPWTFGQGTKVEIKRTVAAPSVFIFPPSDEQ LKSGTASVVCLLNNFYPREAKVQWKVDNALQSGNSQESVTEQD SKDSTYSLSSTLTLSKADYEKHKVYACEVTHQGLSSPVTKSFN RGEC | 133 |

CD40 (hVH3/hVK2) × FAP (4B9) (2 + 2)

| Construct | Sequence | Seq ID No |
|---|---|---|
| hVH3_CD40- Fc_PGLALA_4B9_VLCH1 (charged) | QVQLVQSGAEVKKPGASVKVSCKASGYSFTGYYIHWVRQAPGQ GLEWIGRVIPNAGGTSYNQKFKGRVTSTVDTSISTAYMELSRL RSDDTVVYYCAREGIYWWGQGTTVTVSSASTKGPSVFPLAPSS KSTSGGTAALGCLVEDYFPEPVTVSWNSGALTSGVHTFPAVLQ SSGLYSLSSVVTVPSSSLGTQTYICNVNHKPSNTKVDEKVEPK SCDKTHTCPPCPAPEAAGGPSVFLFPPKPKDTLMISRTPEVTC VVVDVSHEDPEVKFNWYVDGVEVHNAKTKPREEQYNSTYRVVS VLTVLHQDWLNGKEYKCKVSNKALGAPIEKTISKAKGQPREPQ VYTLPPSRDELTKNQVSLTCLVKGFYPSDIAVEWESNGQPENN YKTTPPVLDSDGSFFLYSKLTVDKSRWQQGNVFSCSVMHEALH NHYTQKSLSLSPGGGGSGGGGSGGGGSGGGGSEIVLTQSPGT LSLSPGERATLSCRASQSVTSSYLAWYQQKPGQAPRLLINVGS RRATGIPDRFSGSGSGTDFTLTISRLEPEDFAVYYCQQGIMLP PTFGQGTKVEIKSSASTKGPSVFPLAPSSKSTSGGTAALGCLV KDYFPEPVTVSWNSGALTSGVHTFPAVLQSSGLYSLSSVVTVP SSSLGTQTYICNVNHKPSNTKVDKKVEPKSC | 136 |
| hVK2_CD40 LC (charged) | DVVMTQSPLSLPVTLGQPASISCRSSQSLVHSNGNTFLHWYQQ RPGQSPRLLIYTVSNRFSGVPDRFSGSGSGTDFTLKISRVEAE DVGVYYCSQTTHVPWTFGQGTKVEIKRTVAAPSVFIFPPSDRK LKSGTASVVCLLNNFYPREAKVQWKVDNALQSGNSQESVTEQD SKDSTYSLSSTLTLSKADYEKHKVYACEVTHQGLSSPVTKSFN RGEC | 137 |

TABLE 27-continued

Amino acid sequences of the bispecific antigen binding molecules

| Construct | Sequence | Seq ID No |
|---|---|---|
| 4B9 VHCL | EVQLLESGGGLVQPGGSLRLSCAASGFTFSSYAMSWVRQAPGK GLEWVSAIIGSGASTYYADSVKGRFTISRDNSKNTLYLQMNSL RAEDTAVYYCAKGWFGGFNYWGQGTLVTVSSASVAAPSVFIFP PSDEQLKSGTASVVCLLNNFYPREAKVQWKVDNALQSGNSQES VTEQDSKDSTYSLSSTLTLSKADYEKHKVYACEVTHQGLSSPV TKSFNRGEC | 138 |

CD40 (hVH3/hVK2) × FAP (4B9) (2 + 1) with C-terminal crossFab

| Construct | Sequence | Seq ID No |
|---|---|---|
| hVH3_CD40-Fc knob_PGLALA C-term_x4B9_FAP_VL_CH1 (charged) | QVQLVQSGAEVKKPGASVKVSCKASgysftgyyihWVRQAPGQ GLEWIGrvipnaggtsynqkfkgRVTSTVDTSISTAYMELSRL RSDDTVVYYCARegiywWGQGTTVTVSSASTKGPSVFPLAPSS KSTSGGTAALGCLVEDYFPEPVTVSWNSGALTSGVHTFPAVLQ SSGLYSLSSVVTVPSSSLGTQTYICNVNHKPSNTKVDEKVEPK SCDKTHTCPPCPAPEAAGGPSVFLFPPKPKDTLMISRTPEVTC VVVDVSHEDPEVKFNWYVDGVEVHNAKTKPREEQYNSTYRVVS VLTVLHQDWLNGKEYKCKVSNKALGAPIEKTISKAKGQPREPQ VYTLPPCRDELTKNQVSLWCLVKGFYPSDIAVEWESNGQPENN YKTTPPVLDSDGSFFLYSKLTVDKSRWQQGNVFSCSVMHEALH NHYTQKSLSLSPGGGGSGGGGSGGGGSGGGGSEIVLTQSPGT LSLSPGERATLSCRASQSVTSSYLAWYQQKPGQAPRLLINVGS RRATGIPDRFSGSGSGTDFTLTISRLEPEDFAVYYCQQGIMLP PTFGQGTKVEIKSSASTKGPSVFPLAPSSKSTSGGTAALGCLV KDYFPEPVTVSWNSGALTSGVHTFPAVLQSSGLYSLSSVVTVP SSSLGTQTYICNVNHKPSNTKVDKKVEPKSC | 139 |
| hVH3_CD40-Fc hole_PGLALA (charged) | QVQLVQSGAEVKKPGASVKVSCKASgysftgyyihWVRQAPGQ GLEWIGrvipnaggtsynqkfkgRVTSTVDTSISTAYMELSRL RSDDTVVYYCARegiywWGQGTTVTVSSASTKGPSVFPLAPSS KSTSGGTAALGCLVEDYFPEPVTVSWNSGALTSGVHTFPAVLQ SSGLYSLSSVVTVPSSSLGTQTYICNVNHKPSNTKVDEKVEPK SCDKTHTCPPCPAPEAAGGPSVFLFPPKPKDTLMISRTPEVTC VVVDVSHEDPEVKFNWYVDGVEVHNAKTKPREEQYNSTYRVVS VLTVLHQDWLNGKEYKCKVSNKALGAPIEKTISKAKGQPREPQ VCTLPPSRDELTKNQVSLSCAVKGFYPSDIAVEWESNGQPENN YKTTPPVLDSDGSFFLVSKLTVDKSRWQQGNVFSCSVMHEALH NHYTQKSLSLSPG | 140 |
| +hVK2_CD40 LC (charged) | DVVMTQSPLSLPVTLGQPASISCRSSQSLVHSNGNTFLHWYQQ RPGQSPRLLIYTVSNRFSGVPDRFSGSGSGTDFTLKISRVEAE DVGVYYCSQTTHVPWIFGQGTKVEIKRTVAAPSVFIFPPSDRK LKSGTASVVCLLNNFYPREAKVQWKVDNALQSGNSQESVTEQD SKDSTYSLSSTLTLSKADYEKHKVYACEVTHQGLSSPVTKSFN RGEC | 137 |
| +4B9 VHCL | EVQLLESGGGLVQPGGSLRLSCAASGFTFSSYAMSWVRQAPGK GLEWVSAIIGSGASTYYADSVKGRFTISRDNSKNTLYLQMNSL RAEDTAVYYCAKGWFGGFNYWGQGTLVTVSSASVAAPSVFIFP PSDEQLKSGTASVVCLLNNFYPREAKVQWKVDNALQSGNSQES VTEQDSKDSTYSLSSTLTLSKADYEKHKVYACEVTHQGLSSPV TKSFNRGEC | 138 |

CD40 (hVH3/hVK2) × FAP (4B9) (1 + 1)

| Construct | Sequence | Seq ID No |
|---|---|---|
| 4B9-Fc knob_PGLALA | EIVLTQSPGTLSLSPGERATLSCRASQSVTSSYLAWYQQKPGQ APRLLINVGSRRATGIPDRFSGSGSGTDFTLTISRLEPEDFAV YYCQQGIMLPPTFGQGTKVEIKSSASTKGPSVFPLAPSSKSTS GGTAALGCLVKDYPPEPVTVSWNSGALTSGVHTFPAVLQSSGL YSLSSVVTVPSSSLGTQTYICNVNHKPSNTKVDKKVEPKSCDK THTCPPCPAPEAAGGPSVFLFPPKPKDTLMISRTPEVTCVVVD VSHEDPEVKFNWYVDGVEVHNAKTKPREEQYNSTYRVVSVLTV LHQDWLNGKEYKCKVSNKALGAPIEKTISKAKGQPREPQVYTL PPCRDELTKNQVSLWCLVKGFYPSDIAVEWESNGQPENNYKTT PPVLDSDGSFFLYSKLTVDKSRWQQGNVFSCSVMHEALHNHYT QKSLSLSPG | 141 |
| hVH3_CD40-Fc hole_PGLALA (charged) | QVQLVQSGAEVKKPGASVKVSCKASgysftgyyihWVRQAPGQ GLEWIGrvipnaggtsynqkfkgRVTSTVDTSISTAYMELSRL RSDDTVVYYCARegiywWGQGTTVTVSSASTKGPSVFPLAPSS KSTSGGTAALGCLVEDYFPEPVTVSWNSGALTSGVHTFPAVLQ SSGLYSLSSVVTVPSSSLGTQTYICNVNHKPSNTKVDEKVEPK SCDKTHTCPPCPAPEAAGGPSVFLFPPKPKDTLMISRTPEVTC VVVDVSHEDPEVKFNWYVDGVEVHNAKTKPREEQYNSTYRVVS VLTVLHQDWLNGKEYKCKVSNKALGAPIEKTISKAKGQPREPQ | 140 |

TABLE 27-continued

Amino acid sequences of the bispecific antigen binding molecules

| Construct | Sequence | Seq ID No |
|---|---|---|
|  | VCTLPPSRDELTKNQVSLSCAVKGFYPSDIAVEWESNGQPENN YKTIPPVLDSDGSFFLVSKLIVDKSRWQQGNVFSCSVMHEALH NHYTQKSLSLSPG |  |
| +hVK2_CD40 LC (charged) | DVVMTQSPLSLPVTLGQPASISCRSSQSLVHSNGNTFLHWYQQ RPGQSPRLLIYTVSNRFSGVPDRFSGSGSGTDFTLKISRVEAE DVGVYYCSQTTHVPWIFGQGTKVEIKRTVAAPSVFIFPPSDRK LKSGTASVVCLLNNFYPREAKVQWKVDNALQSGNSQESVTEQD SKDSTYSLSSTLTLSKADYEKHKVYACEVTHQGLSSPVTKSFN RGEC | 137 |
| +4B9 VHCL | EVQLLESGGGLVQPGGSLRLSCAASGFTFSSYAMSWVRQAPGK GLEWVSAIIGSGASTYYADSVKGRFTISRDNSKNTLYLQMNSL RAEDTAVYYCAKGWFGGFNYWGQGTLVTVSSASVAAPSVFIFP PSDEQLKSGTASVVCLLNNFYPREAKVQWKVDNALQSGNSQES VTEQDSKDSTYSLSSTLTLSKADYEKHKVYACEVTHQGLSSPV TKSFNRGEC | 138 |

Further bispecific antibodies were prepared with the new humanized CD40 antibody variants as described in Example 4.2. Specific sequences of such bispecific antibodies are shown in Table 28 below. In particular, different bispecific CD40-FAP antibodies were prepared in 4+1 format consisting of four CD40 binding moieties combined with one FAP binding moiety as crossover fab fragment fused to the C-terminus of the Fc knob chain (FIG. 15F and FIG. 15G) or in 2+1 format consisting of two CD40 binding moieties combined with either one FAP binding moiety as crossover fab fragment, wherein the VL-CH1 chain is fused at the C-terminus of the Fc knob chain (FIG. 15H) or one FAP binding moiety as crossover fab fragment, wherein the VH-CL chain is fused at the C-terminus of the Fc knob chain (FIG. 15I).

TABLE 28

Amino acid sequences of bispecific antigen binding molecules

| Construct | Sequence | Seq ID No |
|---|---|---|
| P1AE0889 CD40 (VH2a/VL2a) x FAP (28H1) (4 + 1) C-terminal crossFab fusion | | |
| 28H1 light chain cross VHCL | EVQLLESGGGLVQPGGSLRLSCAASGFTFSSHAMSWVRQAPGK GLEWVSAIWASGEQYYADSVKGRFTISRDNSKNTLYLQMNSLR AEDTAVYYCAKGWLGNFDYWGQGTLVTVSSASVAAPSVFIFPP SDEQLKSGTASVVCLLNNFYPREAKVQWKVDNALQSGNSQESV TEQDSKDSTYSLSSTLTLSKADYEKHKVYACEVTHQGLSSPVT KSFNRGEC | 162 |
| VL2a (CD40) light chain (charged) | DIQMTQSPSSLSASVGDRVTITCRSSQSLVHSNGNTFLHWYQQ KPGKAPKLLIYTVSNRFSGVPSRFSGSGSGTDFTLTISSLQPE DFATYFCSQTTHVPWTFGGGTKVEIKRTVAAPSVFIFPPSDRK LKSGTASVVCLLNNFYPREAKVQWKVDNALQSGNSQESVTEQD SKDSTYSLSSTLTLSKADYEKHKVYACEVTHQGLSSPVTKSFN RGEC | 243 |
| VH2a (CD40) (VHCH1 charged_VH2a (CD40) (VHCH1 charged)-Fc knob_PGLALA_28H1 (VLCH1) | EVQLLESGGGLVQPGGSLRLSCAASGYSFTGYYIHWVRQAPGK GLEWVGRVIPNAGGTSYNQKFKGRFTISVDNSKNTAYLQMNSL RAEDTAVYYCAREGIYWWGQGTTVTVSSASTKGPSVFPLAPSS KSTSGGTAALGCLVEDYFPEPVTVSWNSGALTSGVHTFPAVLQ SSGLYSLSSVVTVPSSSLGTQTYICNVNHKPSNTKVDEKVEPK SCDGGGGSGGGGSEVQLLESGGGLVQPGGSLRLSCAASGYSFT GYYIHWVRQAPGKGLEWVGRVIPNAGGTSYNQKFKGRFTISVD NSKNTAYLQMNSLRAEDTAVYYCAREGIYWWGQGTTVTVSSAS TKGPSVFPLAPSSKSTSGGTAALGCLVEDYFPEPVTVSWNSGA LTSGVHTFPAVLQSSGLYSLSSVVTVPSSSLGTQTYICNVNHK PSNTKVDEKVEPKSCDKTHTCPPCPAPEAAGGPSVFLFPPKPK DTLMISRTPEVTCVVVDVSHEDPEVKFNWYVDGVEVHNAKTKP REEQYNSTYRVVSVLTVLHQDWLNGKEYKCKVSNKALGAPIEK TISKAKGQPREPQVYTLPPCRDELTKNQVSLWCLVKGFYPSDI AVEWESNGQPENNYKTTPPVLDSDGSFFLYSKLTVDKSRWQQG NVFSCSVMHEALHNHYTQKSLSLSPGGGGSGGGGSGGGGSGG GGSEIVLTQSPGTLSLSPGERATLSCRASQSVSRSYLAWYQQK PGQAPRLLIIGASTRATGIPDRFSGSGSGTDFTLTISRLEPED | 244 |

TABLE 28-continued

Amino acid sequences of bispecific antigen binding molecules

| Construct | Sequence | Seq ID No |
|---|---|---|
| | FAVYYCQQGQVIPPTFGQGTKVEIKSSASTKGPSVFPLAPSSK STSGGTAALGCLVKDYFPEPVTVSWNSGALTSGVHTFPAVLQS SGLYSLSSVVTVPSSSLGTQTYICNVNHKPSNTKVDKKVEPKS C | |
| VH2a (CD40) (VHCH1 charged_VH2a (CD40) (VHCH1 charged)-Fc hole PGLALA | EVQLLESGGGLVQPGGSLRLSCAASGYSFTGYYIHWVRQAPGK GLEWVGRVIPNAGGTSYNQKFKGRFTISVDNSKNTAYLQMNSL RAEDTAVYYCAREGIYWWGQGTTVTVSSASTKGPSVFPLAPSS KSTSGGTAALGCLVEDYFPEPVTVSWNSGALTSGVHTFPAVLQ SSGLYSLSSVVTVPSSSLGTQTYICNVNHKPSNTKVDEKVEPK SCDGGGSGGGGSEVQLLESGGGLVQPGGSLRLSCAASGYSFT GYYIHWVRQAPGKGLEWVGRVIPNAGGTSYNQKFKGRFTISVD NSKNTAYLQMNSLRAEDTAVYYCAREGIYWWGQGTTVTVSSAS TKGPSVFPLAPSSKSTSGGTAALGCLVEDYFPEPVTVSWNSGA LTSGVHTFPAVLQSSGLYSLSSVVTVPSSSLGTQTYICNVNHK PSNTKVDEKVEPKSCDKTHTCPPCPAPEAAGGPSVFLFPPKPK DTLMISRTPEVTCVVVDVSHEDPEVKFNWYVDGVEVHNAKTKP REEQYNSTYRVVSVLTVLHQDWLNGKEYKCKVSNKALGAPIEK TISKAKGQPREPQVCTLPPSRDELTKNQVSLSCAVKGFYPSDI AVEWESNGQPENNYKTTPPVLDSDGSFFLVSKLTVDKSRWQQG NVFSCSVMHEALHNHYTQKSLSLSPG | 245 |

P1AE0890
CD40 (VH2d/VL2a) × FAP (28H1) (4 + 1) C-terminal crossFab fusion

| Construct | Sequence | Seq ID No |
|---|---|---|
| 28H1 light chain cross VHCL | EVQLLESGGGLVQPGGSLRLSCAASGFTFSSHAMSWVRQAPGK GLEWVSAIWASGEQYYADSVKGRFTISRDNSKNTLYLQMNSLR AEDTAVYYCAKGWLGNFDYWGQGTLVTVSSASVAAPSVFIFPP SDEQLKSGTASVVCLLNNFYPREAKVQWKVDNALQSGNSQESV TEQDSKDSTYSLSSTLTLSKADYEKHKVYACEVTHQGLSSPVT KSFNRGEC | 162 |
| VL2a (CD40) light chain (charged) | DIQMTQSPSSLSASVGDRVTITCRSSQSLVHSNGNTFLHWYQQ KPGKAPKLLIYTVSNRFSGVPSRFSGSGSGTDFTLTISSLQPE DFATYFCSQTTHVPWTFGGGTKVEIKRTVAAPSVFIFPPSDRK LKSGTASVVCLLNNFYPREAKVQWKVDNALQSGNSQESVTEQD SKDSTYSLSSTLTLSKADYEKHKVYACEVTHQGLSSPVTKSFN RGEC | 243 |
| VH2d (CD40) (VHCH1 charged_VH2d (CD40) (VHCH1 charged)-Fc knob_PGLALA_28H1 (VLCH1) | EVQLLESGGGLVQPGGSLRLSCAASGYSFTGYYIHWVRQAPGK GLEWVGRVIPNAGGTSYGDSVKGRFTISVDNSKNTAYLQMNSL RAEDTAVYYCAREGIYWWGQGTTVTVSSASTKGPSVFPLAPSS KSTSGGTAALGCLVEDYFPEPVTVSWNSGALTSGVHTFPAVLQ SSGLYSLSSVVTVPSSSLGTQTYICNVNHKPSNTKVDEKVEPK SCDGGGSGGGGSEVQLLESGGGLVQPGGSLRLSCAASGYSFT GYYIHWVRQAPGKGLEWVGRVIPNAGGTSYGDSVKGRFTISVD NSKNTAYLQMNSLRAEDTAVYYCAREGIYWWGQGTTVTVSSAS TKGPSVFPLAPSSKSTSGGTAALGCLVEDYFPEPVTVSWNSGA LTSGVHTFPAVLQSSGLYSLSSVVTVPSSSLGTQTYICNVNHK PSNTKVDEKVEPKSCDKTHTCPPCPAPEAAGGPSVFLFPPKPK DTLMISRTPEVTCVVVDVSHEDPEVKFNWYVDGVEVHNAKTKP REEQYNSTYRVVSVLTVLHQDWLNGKEYKCKVSNKALGAPIEK TISKAKGQPREPQVYTLPPCRDELTKNQVSLWCLVKGFYPSDI AVEWESNGQPENNYKTTPPVLDSDGSFFLYSKLTVDKSRWQQG NVFSCSVMHEALHNHYTQKSLSLSPGGGGGSGGGGSGGGGSGG GGSEIVLTQSPGTLSLSPGERATLSCRASQSVSRSYLAWYQQK PGQAPRLLIIGASTRATGIPDRFSGSGSGTDFTLTISRLEPED FAVYYCQQGQVIPPTFGQGTKVEIKSSASTKGPSVFPLAPSSK STSGGTAALGCLVKDYFPEPVTVSWNSGALTSGVHTFPAVLQS SGLYSLSSVVTVPSSSLGTQTYICNVNHKPSNTKVDKKVEPKS C | 246 |
| VH2d (CD40) (VHCH1 charged_VH2d (CD40) (VHCH1 charged)-Fc hole_PGLALA | EVQLLESGGGLVQPGGSLRLSCAASGYSFTGYYIHWVRQAPGK GLEWVGRVIPNAGGTSYGDSVKGRFTISVDNSKNTAYLQMNSL RAEDTAVYYCAREGIYWWGQGTTVTVSSASTKGPSVFPLAPSS KSTSGGTAALGCLVEDYFPEPVTVSWNSGALTSGVHTFPAVLQ SSGLYSLSSVVTVPSSSLGTQTYICNVNHKPSNTKVDEKVEPK SCDGGGSGGGGSEVQLLESGGGLVQPGGSLRLSCAASGYSFT GYYIHWVRQAPGKGLEWVGRVIPNAGGTSYGDSVKGRFTISVD NSKNTAYLQMNSLRAEDTAVYYCAREGIYWWGQGTTVTVSSAS TKGPSVFPLAPSSKSTSGGTAALGCLVEDYFPEPVTVSWNSGA LTSGVHTFPAVLQSSGLYSLSSVVTVPSSSLGTQTYICNVNHK PSNTKVDEKVEPKSCDKTHTCPPCPAPEAAGGPSVFLFPPKPK DTLMISRTPEVTCVVVDVSHEDPEVKFNWYVDGVEVHNAKTKP REEQYNSTYRVVSVLTVLHQDWLNGKEYKCKVSNKALGAPIEK | 247 |

TABLE 28-continued

Amino acid sequences of bispecific antigen binding molecules

| Construct | Sequence | Seq ID No |
|---|---|---|
| | TISKAKGQPREPQVCTLPPSRDELTKNQVSLSCAVKGFYPSDI<br>AVEWESNGQPENNYKTTPPVLDSDGSFFLVSKLTVDKSRWQQG<br>NVFSCSVMHEALHNHYTQKSLSLSPG | |

P1AE2024
CD40 (VH1a/VL1a) x FAP (28H1) (4 + 1) C-terminal crossFab fusion

| Construct | Sequence | Seq ID No |
|---|---|---|
| 28H1 light chain cross VHCL | EVQLLESGGGLVQPGGSLRLSCAASGFTFSSHAMSWVRQAPGK<br>GLEWVSAIWASGEQYYADSVKGRFTISRDNSKNTLYLQMNSLR<br>AEDTAVYYCAKGWLGNFDYWGQGTLVTVSSASVAAPSVFIFPP<br>SDEQLKSGTASVVCLLNNFYPREAKVQWKVDNALQSGNSQESV<br>TEQDSKDSTYSLSSTLTLSKADYEKHKVYACEVTHQGLSSPVT<br>KSFNRGEC | 162 |
| VL1a (CD40) light chain (charged) | DIVMTQTPLSLSVTPGQPASISCRSSQSLVHSNGNTFLHWYLQ<br>KPGQSPQLLIYTVSNRFSGVPDRFSGSGSGTDFTLKISRVEAE<br>DVGVYFCSQTTHVPWTFGGGTKVEIKRTVAAPSVFIFPPSDRK<br>LKSGTASVVCLLNNFYPREAKVQWKVDNALQSGNSQESVTEQD<br>SKDSTYSLSSTLTLSKADYEKHKVYACEVTHQGLSSPVTKSFN<br>RGEC | 248 |
| VH1a (CD40) (VHCH1)_VH1a (CD40) (VHCH1) Fc knob_PGLALA 28H1 (VLCH1) (charged) | QVQLVQSGAEVKKPGASVKVSCKASGYSFTGYYIHWVRQAPGQ<br>SLEWMGRVIPNAGGTSYNQKFKGRVTLTVDKSISTAYMELSRL<br>RSDDTAVYYCAREGIYWWGQGTTVTVSSASTKGPSVFPLAPSS<br>KSTSGGTAALGCLVEDYFPEPVTVSWNSGALTSGVHTFPAVLQ<br>SSGLYSLSSVVTVPSSSLGTQTYICNVNHKPSNTKVDEKVEPK<br>SCDGGGGSGGGGSQVQLVQSGAEVKKPGASVKVSCKASGYSFT<br>GYYIHWVRQAPGQSLEWMGRVIPNAGGTSYNQKFKGRVTLTVD<br>KSISTAYMELSRLRSDDTAVYYCAREGIYWWGQGTTVTVSSAS<br>TKGPSVFPLAPSSKSTSGGTAALGCLVEDYFPEPVTVSWNSGA<br>LTSGVHTFPAVLQSSGLYSLSSVVTVPSSSLGTQTYICNVNHK<br>PSNTKVDEKVEPKSCDKTHTCPPCPAPEAAGGPSVFLFPPKPK<br>DTLMISRTPEVTCVVVDVSHEDPEVKFNWYVDGVEVHNAKTKP<br>REEQYNSTYRVVSVLTVLHQDWLNGKEYKCKVSNKALGAPIEK<br>TISKAKGQPREPQVYTLPPCRDELTKNQVSLWCLVKGFYPSDI<br>AVEWESNGQPENNYKTTPPVLDSDGSFFLYSKLTVDKSRWQQG<br>NVFSCSVMHEALHNHYTQKSLSLSPGGGGSGGGGSGGGGSGG<br>GGSEIVLTQSPGTLSLSPGERATLSCRASQSVSRSYLAWYQQK<br>PGQAPRLLIIGASTRATGIPDRFSGSGSGTDFTLTISRLEPED<br>FAVYYCQQGQVIPPTFGQGTKVEIKSSASTKGPSVFPLAPSSK<br>STSGGTAALGCLVKDYFPEPVTVSWNSGALTSGVHTFPAVLQS<br>SGLYSLSSVVTVPSSSLGTQTYICNVNHKPSNTKVDKKVEPKS<br>C | 249 |
| VH1a (CD40) (VHCH1)_VH1a (CD40) (VHCH1)-Fc hole_PGLALA (charged) | QVQLVQSGAEVKKPGASVKVSCKASGYSFTGYYIHWVRQAPGQ<br>SLEWMGRVIPNAGGTSYNQKFKGRVTLTVDKSISTAYMELSRL<br>RSDDTAVYYCAREGIYWWGQGTTVTVSSASTKGPSVFPLAPSS<br>KSTSGGTAALGCLVEDYFPEPVTVSWNSGALTSGVHTFPAVLQ<br>SSGLYSLSSVVTVPSSSLGTQTYICNVNHKPSNTKVDEKVEPK<br>SCDGGGGSGGGGSQVQLVQSGAEVKKPGASVKVSCKASGYSFT<br>GYYIHWVRQAPGQSLEWMGRVIPNAGGTSYNQKFKGRVTLTVD<br>KSISTAYMELSRLRSDDTAVYYCAREGIYWWGQGTTVTVSSAS<br>TKGPSVFPLAPSSKSTSGGTAALGCLVEDYFPEPVTVSWNSGA<br>LTSGVHTFPAVLQSSGLYSLSSVVTVPSSSLGTQTYICNVNHK<br>PSNTKVDEKVEPKSCDKTHTCPPCPAPEAAGGPSVFLFPPKPK<br>DTLMISRTPEVTCVVVDVSHEDPEVKFNWYVDGVEVHNAKTKP<br>REEQYNSTYRVVSVLTVLHQDWLNGKEYKCKVSNKALGAPIEK<br>TISKAKGQPREPQVCTLPPSRDELTKNQVSLSCAVKGFYPSDI<br>AVEWESNGQPENNYKTTPPVLDSDGSFFLVSKLTVDKSRWQQG<br>NVFSCSVMHEALHNHYTQKSLSLSPG | 250 |

P1AE2302
CD40 (VH1a/VL1a) x FAP (28H1) (2 + 1) C-terminal crossFab fusion

| Construct | Sequence | Seq ID No |
|---|---|---|
| 28H1 light chain cross VHCL | EVQLLESGGGLVQPGGSLRLSCAASGFTFSSHAMSWVRQAPGK<br>GLEWVSAIWASGEQYYADSVKGRFTISRDNSKNTLYLQMNSLR<br>AEDTAVYYCAKGWLGNFDYWGQGTLVTVSSASVAAPSVFIFPP<br>SDEQLKSGTASVVCLLNNFYPREAKVQWKVDNALQSGNSQESV<br>TEQDSKDSTYSLSSTLTLSKADYEKHKVYACEVTHQGLSSPVT<br>KSFNRGEC | 162 |

TABLE 28-continued

Amino acid sequences of bispecific antigen binding molecules

| Construct | Sequence | Seq ID No |
|---|---|---|
| VL1a (CD40) light chain (charged) | DIVMTQTPLSLSVTPGQPASISCRSSQSLVHSNGNTFLHWYLQ KPGQSPQLLIYTVSNRFSGVPDRFSGSGSGTDFTLKISRVEAE DVGVYFCSQTTHVPWTFGGGTKVEIKRTVAAPSVFIFPPSDRK LKSGTASVVCLLNNFYPREAKVQWKVDNALQSGNSQESVTEQD SKDSTYSLSSTLTLSKADYEKHKVYACEVTHQGLSSPVTKSFN RGEC | 248 |
| VH1a (CD40) (VHCH1) Fc knob_PGLALA_28H1 (VLCH1) (charged) | QVQLVQSGAEVKKPGASVKVSCKASGYSFTGYYIHWVRQAPGQ SLEWMGRVIPNAGGTSYNQKFKGRVTLTVDKSISTAYMELSRL RSDDTAVYYCAREGIYWWGQGTTVTVSSASTKGPSVFPLAPSS KSTSGGTAALGCLVEDYFPEPVTVSWNSGALTSGVHTFPAVLQ SSGLYSLSSVVTVPSSSLGTQTYICNVNHKPSNTKVDEKVEPK SCDKTHTCPPCPAPEAAGGPSVFLFPPKPKDTLMISRTPEVTC VVVDVSHEDPEVKFNWYVDGVEVHNAKTKPREEQYNSTYRVVS VLTVLHQDWLNGKEYKCKVSNKALGAPIEKTISKAKGQPREPQ VYTLPPCRDELTKNQVSLWCLVKGFYPSDIAVEWESNGQPENN YKTTPPVLDSDGSFFLYSKLTVDKSRWQQGNVFSCSVMHEALH NHYTQKSLSLSPGGGGSGGGGSGGGGSGGGGSEIVLTQSPGT LSLSPGERATLSCRASQSVSRSYLAWYQQKPGQAPRLLIIGAS TRATGIPDRFSGSGSGTDFTLTISRLEPEDFAVYYCQQGVIP PTFGQGTKVEIKSSASTKGPSVFPLAPSSKSTSGGTAALGCLV KDYFPEPVTVSWNSGALTSGVHTFPAVLQSSGLYSLSSVVTVP SSSLGTQTYICNVNHKPSNTKVDKKVEPKSC | 251 |
| VH1a (CD40) (VHCH1) Fc hole_PGLALA (charged) | QVQLVQSGAEVKKPGASVKVSCKASGYSFTGYYIHWVRQAPGQ SLEWMGRVIPNAGGTSYNQKFKGRVTLTVDKSISTAYMELSRL RSDDTAVYYCAREGIYWWGQGTTVTVSSASTKGPSVFPLAPSS KSTSGGTAALGCLVEDYFPEPVTVSWNSGALTSGVHTFPAVLQ SSGLYSLSSVVTVPSSSLGTQTYICNVNHKPSNTKVDEKVEPK SCDKTHTCPPCPAPEAAGGPSVFLFPPKPKDTLMISRTPEVTC VVVDVSHEDPEVKFNWYVDGVEVHNAKTKPREEQYNSTYRVVS VLTVLHQDWLNGKEYKCKVSNKALGAPIEKTISKAKGQPREPQ VCTLPPSRDELTKNQVSLSCAVKGFYPSDIAVEWESNGQPENN YKTTPPVLDSDGSFFLVSKLTVDKSRWQQGNVFSCSVMHEALH NHYTQKSLSLSPG | 252 |

P1AE2402
CD40 (VH1a/VL1a) × FAP (4B9) (2 + 1) C-terminal crossFab fusion

| 4B9 light chain cross VHCL | EVQLLESGGGLVQPGGSLRLSCAASGFTFSSYAMSWVRQAPGK GLEWVSAIIGSGASTYYADSVKGRFTISRDNSKNTLYLQMNSL RAEDTAVYYCAKGWFGGFNYWGQGTLVTVSSASVAAPSVFIFP PSDEQLKSGTASVVCLLNNFYPREAKVQWKVDNALQSGNSQES VTEQDSKDSTYSLSSTLTLSKADYEKHKVYACEVTHQGLSSPV TKSFNRGEC | 138 |
| VL1a (CD40) light chain (charged) | DIVMTQTPLSLSVTPGQPASISCRSSQSLVHSNGNT- FLHWYLQ248 KPGQSPQLLIYTVSNRFSGVPDRFSGSGSGTDFTLKISRVEAE DVGVYFCSQTTHVPWTFGGGTKVEIKRTVAAPSVFIFPPSDRK LKSGTASVVCLLNNFYPREAKVQWKVDNALQSGNSQESVTEQD SKDSTYSLSSTLTLSKADYEKHKVYACEVTHQGLSSPVTKSFN RGEC | |
| VH1a (CD40) (VHCH1) Fc knob_PGLALA_4B9 (VLCH1) (charged) | QVQLVQSGAEVKKPGASVKVSCKASGYSFTGYYIHWVRQAPGQ SLEWMGRVIPNAGGTSYNQKFKGRVTLTVDKSISTAYMELSRL RSDDTAVYYCAREGIYWWGQGTTVTVSSASTKGPSVFPLAPSS KSTSGGTAALGCLVEDYFPEPVTVSWNSGALTSGVHTFPAVLQ SSGLYSLSSVVTVPSSSLGTQTYICNVNHKPSNTKVDEKVEPK SCDKTHTCPPCPAPEAAGGPSVFLFPPKPKDTLMISRTPEVTC VVVDVSHEDPEVKFNWYVDGVEVHNAKTKPREEQYNSTYRVVS VLTVLHQDWLNGKEYKCKVSNKALGAPIEKTISKAKGQPREPQ VYTLPPCRDELTKNQVSLWCLVKGFYPSDIAVEWESNGQPENN YKTTPPVLDSDGSFFLYSKLTVDKSRWQQGNVFSCSVMHEALH NHYTQKSLSLSPGGGGSGGGGSGGGGSGGGGSEIVLTQSPGT LSLSPGERATLSCRASQSVTSSYLAWYQQKPGQAPRLLINVGS RRATGIPDRFSGSGSGTDFTLTISRLEPEDFAVYYCQQGIMLP PTFGQGTKVEIKSSASTKGPSVFPLAPSSKSTSGGTAALGCLV KDYFPEPVTVSWNSGALTSGVHTFPAVLQSSGLYSLSSVVTVP SSSLGTQTYICNVNHKPSNTKVDKKVEPKSC | 253 |

TABLE 28-continued

Amino acid sequences of bispecific antigen binding molecules

| Construct | Sequence | Seq ID No |
|---|---|---|
| VH1a (CD40) (VHCH1) Fc hole_PGLALA (charged) | QVQLVQSGAEVKKPGASVKVSCKASGYSFTGYYIHWVRQAPGQ SLEWMGRVIPNAGGTSYNQKFKGRVTLTVDKSISTAYMELSRL RSDDTAVYYCAREGIYWWGQGTTVTVSSASTKGPSVFPLAPSS KSTSGGTAALGCLVEDYFPEPVTVSWNSGALTSGVHTFPAVLQ SSGLYSLSSVVTVPSSSLGTQTYICNVNHKPSNTKVDKKVEPK SCDKTHTCPPCPAPEAAGGPSVFLFPPKPKDTLMISRTPEVTC VVVDVSHEDPEVKFNWYVDGVEVHNAKTKPREEQYNSTYRVVS VLTVLHQDWLNGKEYKCKVSNKALGAPIEKTISKAKGQPREPQ VCTLPPSRDELTKNQVSLSCAVKGFYPSDIAVEWESNGQPENN YKTTPPVLDSDGSFFLVSKLTVDKSRWQQGNVFSCSVMHEALH NHYTQKSLSLSPG | 252 |

P1AE2408
CD40 (VH1a/VL1a) x FAP (4B9) (2 + 1) C-terminal crossFab fusion

| 4B9 light chain cross VLCH1 | EIVLTQSPGTLSLSPGERATLSCRASQSVTSSYLAWYQQKPGQ APRLLINVGSRRATGIPDRFSGSGSGTDFTLTISRLEPEDFAV YYCQQGIMLPPTFGQGTKVEIKSSASTKGPSVFPLAPSSKSTS GGTAALGCLVKDYFPEPVTVSWNSGALTSGVHTFPAVLQSSGL YSLSSVVTVPSSSLGTQTYICNVNHKPSNTKVDKKVEPKSC | 254 |
| VL1a (CD40) light chain (charged) | DIVMTQTPLSLSVTPGQPASISCRSSQSLVHSNGNTFLHWYLQ KPGQSPQLLIYTVSNRFSGVPDRFSGSGSGTDFTLKISRVEAE DVGVYFCSQTTHVPWTFGGGTKVEIKRTVAAPSVFIFPPSDRK LKSGTASVVCLLNNFYPREAKVQWKVDNALQSGNSQESVTEQD SKDSTYSLSSTLTLSKADYEKHKVYACEVTHQGLSSPVTKSFN RGEC | 248 |
| VH1a (CD40) (VHCH1) Fc knob_PGLALA_4B9 (VHCL) (charged) | QVQLVQSGAEVKKPGASVKVSCKASGYSFTGYYIHWVRQAPGQ SLEWMGRVIPNAGGTSYNQKFKGRVTLTVDKSISTAYMELSRL RSDDTAVYYCAREGIYWWGQGTTVTVSSASTKGPSVFPLAPSS KSTSGGTAALGCLVEDYFPEPVTVSWNSGALTSGVHTFPAVLQ SSGLYSLSSVVTVPSSSLGTQTYICNVNHKPSNTKVDKKVEPK SCDKTHTCPPCPAPEAAGGPSVFLFPPKPKDTLMISRTPEVTC VVVDVSHEDPEVKFNWYVDGVEVHNAKTKPREEQYNSTYRVVS VLTVLHQDWLNGKEYKCKVSNKALGAPIEKTISKAKGQPREPQ VYTLPPCRDELTKNQVSLWCLVKGFYPSDIAVEWESNGQPENN YKTTPPVLDSDGSFFLYSKLTVDKSRWQQGNVFSCSVMHEALH NHYTQKSLSLSPGGGGSGGGGSGGGGSGGGGSEVQLLESGGG LVQPGGSLRLSCAASGFTFSSYAMSWVRQAPGKGLEWVSAIIG SGASTYYADSVKGRFTISRDNSKNTLYLQMNSLRAEDTAVYYC AKGWFGGFNYWGQGTLVTVSSASVAAPSVFIFPPSDEQLKSGT ASVVCLLNNFYPREAKVQWKVDNALQSGNSQESVTEQDSKDST YSLSSTLTLSKADYEKHKVYACEVTHQGLSSPVTKSFNRGEC | 255 |
| VH1a (CD40) (VHCH1) Fc hole_PGLALA (charged) | QVQLVQSGAEVKKPGASVKVSCKASGYSFTGYYIHWVRQAPGQ SLEWMGRVIPNAGGTSYNQKFKGRVTLTVDKSISTAYMELSRL RSDDTAVYYCAREGIYWWGQGTTVTVSSASTKGPSVFPLAPSS KSTSGGTAALGCLVEDYFPEPVTVSWNSGALTSGVHTFPAVLQ SSGLYSLSSVVTVPSSSLGTQTYICNVNHKPSNTKVDKKVEPK SCDKTHTCPPCPAPEAAGGPSVFLFPPKPKDTLMISRTPEVTC VVVDVSHEDPEVKFNWYVDGVEVHNAKTKPREEQYNSTYRVVS VLTVLHQDWLNGKEYKCKVSNKALGAPIEKTISKAKGQPREPQ VCTLPPSRDELTKNQVSLSCAVKGFYPSDIAVEWESNGQPENN YKTTPPVLDSDGSFFLVSKLTVDKSRWQQGNVFSCSVMHEALH NHYTQKSLSLSPG | 252 |

P1AE2487
CD40 (VH1a/VL1a) x FAP (4B9) (2 + 1) C-terminal crossFab fusion

| 4B9 light chain cross VLCH | EIVLTQSPGTLSLSPGERATLSCRASQSVTSSYLAWYQQKPGQ APRLLINVGSRRATGIPDRFSGSGSGTDFTLTISRLEPEDFAV YYCQQGIMLPPTFGQGTKVEIKSSASTKGPSVFPLAPSSKSTS GGTAALGCLVKDYFPEPVTVSWNSGALTSGVHTFPAVLQSSGL YSLSSVVTVPSSSLGTQTYICNVNHKPSNTKVDKKVEPKSC | 254 |
| VL1a (CD40) light chain | DIVMTQTPLSLSVTPGQPASISCRSSQSLVHSNGNTFLHWYLQ KPGQSPQLLIYTVSNRFSGVPDRFSGSGSGTDFTLKISRVEAE DVGVYFCSQTTHVPWTFGGGTKVEIKRTVAAPSVFIFPPSDEQ LKSGTASVVCLLNNFYPREAKVQWKVDNALQSGNSQESVTEQD SKDSTYSLSSTLTLSKADYEKHKVYACEVTHQGLSSPVTKSFN RGEC | 256 |

TABLE 28-continued

Amino acid sequences of bispecific antigen binding molecules

| Construct | Sequence | Seq ID No |
|---|---|---|
| VH1a (CD40) (VHCH1) Fc knob_PGLALA_4B9 (VHCL) | QVQLVQSGAEVKKPGASVKVSCKASGYSFTGYYIHWVRQAPGQ SLEWMGRVIPNAGGTSYNQKFKGRVTLTVDKSISTAYMELSRL RSDDTAVYYCAREGIYWWGQGTTVTVSSASTKGPSVFPLAPSS KSTSGGTAALGCLVKDYFPEPVTVSWNSGALTSGVHTFPAVLQ SSGLYSLSSVVTVPSSSLGTQTYICNVNHKPSNTKVDKKVEPK SCDKTHTCPPCPAPEAAGGPSVFLFPPKPKDTLMISRTPEVTC VVVDVSHEDPEVKFNWYVDGVEVHNAKTKPREEQYNSTYRVVS VLTVLHQDWLNGKEYKCKVSNKALGAPIEKTISKAKGQPREPQ VYTLPPCRDELTKNQVSLWCLVKGFYPSDIAVEWESNGQPENN YKTTPPVLDSDGSFFLYSKLTVDKSRWQQGNVFSCSVMHEALH NHYTQKSLSLSPGGGGSGGGGSGGGGSGGGGSEVQLLESGGG LVQPGGSLRLSCAASGFTFSSYAMSWVRQAPGKGLEWVSAIIG SGASTYYADSVKGRFTISRDNSKNTLYLQMNSLRAEDTAVYYC AKGWFGGFNYWGQGTLVTVSSASVAAPSVFIFPPSDEQLKSGT ASVVCLLNNFYPREAKVQWKVDNALQSGNSQESVTEQDSKDST YSLSSTLTLSKADYEKHKVYACEVTHQGLSSPVTKSFNRGEC | 257 |
| VH1a (CD40) (VHCH1) Fc hole_PGLALA | QVQLVQSGAEVKKPGASVKVSCKASGYSFTGYYIHWVRQAPGQ SLEWMGRVIPNAGGTSYNQKFKGRVTLTVDKSISTAYMELSRL RSDDTAVYYCAREGIYWWGQGTTVTVSSASTKGPSVFPLAPSS KSTSGGTAALGCLVKDYFPEPVTVSWNSGALTSGVHTFPAVLQ SSGLYSLSSVVTVPSSSLGTQTYICNVNHKPSNTKVDKKVEPK SCDKTHTCPPCPAPEAAGGPSVFLFPPKPKDTLMISRTPEVTC VVVDVSHEDPEVKFNWYVDGVEVHNAKTKPREEQYNSTYRVVS VLTVLHQDWLNGKEYKCKVSNKALGAPIEKTISKAKGQPREPQ VCTLPPSRDELTKNQVSLSCAVKGFYPSDIAVEWESNGQPENN YKTTPPVLDSDGSFFLVSKLTVDKSRWQQGNVFSCSVMHEALH NHYTQKSLSLSPG | 258 |

5.2 Production of Bispecific Antigen Binding Molecules Targeting CD40 and Fibroblast Activation Protein (FAP)

The bispecific antigen binding molecules targeting CD40 and fibroblast activation protein (FAP) were expressed by transient transfection of HEK cells grown in suspension with expression vectors encoding the 4 different peptide chains. Transfection into HEK293-F cells (Invitrogen) was performed according to the cell supplier's instructions using Maxiprep (Qiagen) preparations of the antibody vectors, F17 medium (Invitrogen, USA), PEIPRO® (Polyscience Europe GmbH) and an initial cell density of 1-2 million viable cells/ml in serum free FREESTYLE™ 293 expression medium (Invitrogen). Cell culture supernatants were harvested after 7 days of cultivation in shake flasks or stirred fermenters by centrifugation at 14000 g for 30 minutes and filtered through a 0.22 µm filter.

The bispecific antibodies were purified from cell culture supernatants by affinity chromatography using MabSelect-Sure-Sepharose™ (GE Healthcare, Sweden) chromatography. Briefly, sterile filtered cell culture supernatants were captured on a MabSelect SuRe resin equilibrated with PBS buffer (10 mM $Na_2HPO_4$, 1 mM $KH_2PO_4$, 137 mM NaCl and 2.7 mM KCl, pH 7.4), washed with equilibration buffer and eluted with 25 mM cirate, pH 3.0. After neutralization with 1 M Tris pH 9.0, aggregated protein was separated from monomeric antibody species by size exclusion chromatography (SUPERDEX® 200, GE Healthcare) in 20 mM histidine, 140 mM NaCl, pH 6.0. Monomeric protein fractions were pooled, concentrated if required using e.g. a MILLIPORE Amicon Ultra (30K$_D$ MWCO) centrifugal concentrator and stored at −80° C. Sample aliquots were used for subsequent analytical characterization e.g. by 10 CE-SDS, size exclusion chromatography, mass spectrometry and endotoxin determination.

TABLE 29

Production yield and quality of bispecific CD40 antigen binding molecules

| Construct | | Yield [mg/L] after Protein A and SEC purification | Purity (by % CE-SDS) | Purity (by % SEC) | Affinity to human FAP [nM] |
|---|---|---|---|---|---|
| P1AE2024 | CD40 (VH1a/VL1a) × FAP (28H1) (4 + 1) C-terminal crossFab (knob_VL_CH1) | 6.6 mg/L | 98.2 | 97.8 | 1.2 |
| P1AE2302 | CD40 (VH1a/VL1a) × FAP (28H1) (2 + 1) C-terminal crossFab (knob_VL_CH1) | 12 mg/L | 99 | 99.7 | 0.3 |
| P1AE2402 | CD40 (VH1a/VL1a) × FAP (4B9) (2 + 1) C-terminal crossFab (knob_VL_CH1) | 21 mg/L | 96.4 | 99.2 | 17.3 |
| P1AE2408 | CD40 (VH1a/VL1a) × FAP (4B9) (2 + 1) C-terminal crossFab (knob_VH_Ck) | 18 mg/L | 91.3 | 95.2 | 15.3 |
| P1AE0408 | CD40 × FAP (28H1) (2 + 1) head-to-tail | 42 mg/L | 97.8 | 96.2 | 1.5 |
| P1AE0637 | CD40 × FAP (28H1) (4 + 1) (knob_VL_CH1) | 9.7 mg/L | 98.7 | 100 | 0.1 |

TABLE 29-continued

Production yield and quality of bispecific CD40 antigen binding molecules

| Construct | | Yield [mg/L] after Protein A and SEC purification | Purity (by % CE-SDS) | Purity (by % SEC) | Affinity to human FAP [nM] |
|---|---|---|---|---|---|
| P1AE0889 | CD40 (VH2a/VL2a) × FAP (28H1) 4 + 1 with C-terminal crossFab | 17 mg/L | 96.4 | 99 | nd |
| P1AE2487 | CD40 (VH1a/VL1a) × FAP (4B9) (2 + 1) C-terminal crossFab (knob_VH_Ck) | nd | nd | 99.2 | nd |

5.3 Characterization of the Bispecific Antibodies Comprising Humanized CD40 Antibody Variants and FAP 5.3.1 Binding to Human or Mouse FAP-Expressing Murine Fibroblast Cells The binding to cell surface FAP was tested using human fibroblast activating protein (huFAP) expressing cells NIH/3T3-huFAP clone 19 or mouse fibroblast activating protein (mFAP) expressing cells NIH/3T3-mFAP clone 26 was tested as described in Example 1.4.1. $EC_{50}$ values as measured for some of the bispecific antigen binding molecules comprising humanized CD40 antibody variants are shown in Table 7.

5.3.2 Binding to FAP (Surface Plasmon Resonance)

The capacity of the bispecific constructs to bind human FAP was assessed by surface plasmon resonance (SPR). All SPR experiments were performed on a BIACORE® T200 (BIACORE®) at 25° C., with HBS-EP as running buffer (0.01 M HEPES pH 7.4, 0.15 M NaCl, 3 mM EDTA, 0.005% Surfactant P20, (BIACORE®).

His-tagged human dimeric FAP (recombinant FAP_ECD) was captured on a CM5 chip (GE Healthcare) immobilized with anti-His antibody (Qiagen Cat. No. 34660) by injection of 500 nM huFAP for 60 s at a flow rate of 10 μL/min, 10 nM murine FAP for 20 s at a flow rate of 20 μL/min and 10 nM cynoFAP for 20s at a flow rate of 20 μL/min. Immobilization levels for the anti-His antibody of up to 18000 resonance units (RU) were used. Following the capture step, the bispecific antibodies as well as control molecules were immediately passed over the chip surface at a concentration ranging from 0.78-100 nM with a flow rate of 30 μL/minute for 280 s and a dissociation phase of 180 s. Bulk refractive index differences were corrected for by subtracting the response obtained in a reference flow cell, where no FAP was immobilized. Avidity was determined using the Langmuir 1:1 curve fitting. For bivalent binding the same 1:1 fitting was used leading to an apparent $K_D$ value.

TABLE 30

Binding of exemplary bispecific CD40 × FAP antigen binding molecules to recombinant human FAP_ECD (Biacore)

| Ligand | | KD * (Avidity) | ka (1/Ms) | kd (1/s) |
|---|---|---|---|---|
| Control | 4B9 IgG1 | 0.08 nM | 2.19E+06 | 1.72E−04 |
| P1AD9139 | 4 + 1 with C-terminal VH/VL fusion | 2.7 nM | 5.76E+05 | 1.55E−03 |

TABLE 30-continued

Binding of exemplary bispecific CD40 × FAP antigen binding molecules to recombinant human FAP_ECD (Biacore)

| Ligand | | KD * (Avidity) | ka (1/Ms) | kd (1/s) |
|---|---|---|---|---|
| P1AE0192 | 1 + 1 crossMab | 2.2 nM | 6.63E+05 | 1.45E−03 |
| P1AE0408 | 2 + 1 head-to-tail format | 6.0 nM | 2.91E+05 | 1.74E−03 |
| P1AE0637 | 4 + 1 with C-terminal crossFab | 7.3 nM | 2.82E+05 | 2.05E−03 |

Note:
All $K_D$s are dependent from the specific experimental conditions.

5.3.3 Binding to CD40 (Surface Plasmon Resonance)

The capacity of the bispecific constructs to bind human CD40 was assessed by surface plasmon resonance (SPR). All SPR experiments were performed on a BIACORE® T200 (BIACORE®) at 25° C., with HBS-EP as running buffer (0.01 M HEPES pH 7.4, 0.15 M NaCl, 3 mM EDTA, 0.005% Surfactant P20, (BIACORE®).

In accordance with Example 4.2.7, association was measured by injection of human CD40 extra cellular domain in various concentrations in solution for 300 sec at a flow of 30 μl/min starting with 300 nM in 1:3 dilutions. The dissociation phase was monitored for up to 1200 sec and triggered by switching from the sample solution to running buffer. The surface was regenerated by 60 sec washing with a Glycine pH 2.1 solution at a flow rate of 30 μl/min. Bulk refractive index differences were corrected by subtracting the response obtained from a goat anti human F(ab')$_2$ surface. Blank injections are also subtracted (=double referencing). For calculation of apparent $K_D$ and other kinetic parameters the Langmuir 1:1 model was used. The apparent Kd was calculated using the BIACORE® B4000 evaluation software (version 1.1).

TABLE 31

Binding of exemplary bispecific CD40 × FAP antigen binding molecules to recombinant human CD40_ECD (Biacore)

| Ligand | format description | KD | ka (1/Ms) | kd (1/s) |
|---|---|---|---|---|
| P1AE0192 | 1 + 1 crossMab | 3.7 nM | 2.09E+06 | 7.77E−03 |
| P1AE0408 | 2 + 1 head-to-tail format | 3.6 nM | 2.34E+06 | 8.43E−03 |
| P1AE0637 | 4 + 1 C-terminal crossFab fusion | 4.0 nM | 1.79E+06 | 7.22E−03 |

Note:
All $K_D$s are dependent from the specific experimental conditions.

5.3.4 Binding to Human CD40-Expressing Daudi Cells

The binding to cell surface CD40 was tested using Daudi cells, a human B lymphoblast cell line with high expression levels of human CD40 (ATCC CCL-213) as described in Example 1.4.2. Exemplary $EC_{50}$ values as measured for some of the bispecific antigen binding molecules comprising humanized CD40 antibody variants are shown in Table 8.

5.3.5 Functional Properties of Bispecific Antigen Binding Molecule Comprising Humanized CD40 Antibody Variants The functional properties of the bispecific antigen binding molecules comprising humanized CD40 antibody variants were analyzed in accordance to the experiments described in Example 2. Exemplary data are provided in Tables 9, 10 or 11 as shown herein before.

SEQUENCE LISTING (269 sequences)

SEQ ID NO: 1 - protein, 277 aa, Homo sapiens
MVRLPLQCVLWGCLLTAVHPEPPTACREKQYLINSQCCSLCQPGQKLVSDCTEFTETECLPCGESEFLDTWNRETHCHQHKYCDPNLGLRVQQKGTSETDTICTCEEGWHCTSEACESCVLHRSCSPGFGVKQIATGVSDTICEPCPVGFFSNVSSAFEKCHPWTSCETKDLVVQQAGTNKTDVVCGPQDRLRALVVIPIIFGILFAILLVLVFIKKVAKKPTNKAPHPKQEPQEINFPDDLPGSNTAAPVQETLHGCQPVTQEDGKESRISVQERQ

SEQ ID NO: 2 - protein, 760 aa, Homo sapiens
MKTWVKIVFGVATSAVLALLVMCIVLRPSRVHNSEENTMRALTLKDILNGTFSYKTFFPNWISGQEYLHQSADNNIVLYNIETGQSYTILSNRTMKSVNASNYGLSPDRQFVYLESDYSKLWRYSYTATYYIYDLSNGEFVRGNELPRPIQYLCWSPVGSKLAYVYQNNIYLKQRPGDPPFQITFNGRENKIFNGIPDWVYEEEMLATKYALWWSPNGKFLAYAEFNDTDIPVIAYSYYGDEQYPRTINIPYPKAGAKNPVVRIFIIDTTYPAYVGPQEVPVPAMIASSDYYFSWLTWVTDERVCLQWLKRVQNVSVLSICDFREDWQTWDCPKTQEHIEESRTGWAGGFFVSTPVFSYDAISYYKIFSDKDGYKHIHYIKDTVENAIQITSGKWEAINIFRVTQDSLFYSSNEFEEYPGRRNIYRISIGSYPPSKKCVTCHLRKERCQYYTASFSDYAKYYALVCYGPGIPISTLHDGRTDQEIKILEENKELENALKNIQLPKEEIKKLEVDEITLWYKMILPPQFDRSKKYPLLIQVYGGPCSQSVRSVFAVNWISYLASKEGMVIALVDGRGTAFQGDKLLYAVYRKLGVYEVEDQITAVRKFIEMGFIDEKRIAIWGWSYGGYVSSLALASGTGLFKCGIAVAPVSSWEYYASVYTERFMGLPTKDDNLEHYKNSTVMARAEYFRNVDYLLIHGTADDNVHFQNSAQIAKALVNAQVDFQAMWYSDQNHGLSGLSTNHLYTHMTHFLKQCFSLSD

SEQ ID NO: 3 - protein, 5 aa, Artificial Sequence
  FAP(28H1)  CDR-H1
SHAMS

SEQ ID NO: 4 - protein, 16 aa, Artificial Sequence
  FAP(28H1)  CDR-H2
AIWASGEQYYADSVKG

SEQ ID NO: 5 - protein, 8 aa, Artificial Sequence
  FAP(28H1)  CDR-H3
GWLGNFDY

SEQ ID NO: 6 - protein, 12 aa, Artificial Sequence
  FAP(28H1)  CDR-L1
RASQSVSRSYLA

SEQ ID NO: 7 - protein, 7 aa, Artificial Sequence
  FAP(28H1)  CDR-L2
GASTRAT

SEQ ID NO: 8 - protein, 9 aa, Artificial Sequence
  FAP(28H1)  CDR-L3
QQGQVIPPT

SEQ ID NO: 9 - protein, 116 aa, Artificial Sequence
  FAP(28H1) VH
EVQLLESGGGLVQPGGSLRLSCAASGFTFSSHAMSWVRQAPGKGLEWVSAIWASGEQYYADSVKGRFTISRDNSKNTLYLQMNSLRAEDTAVYYCAKGWLGNFDYWGQGTLVTVSS

SEQ ID NO: 10 - protein, 108 aa, Artificial Sequence
  FAP(28H1) VL
EIVLTQSPGTLSLSPGERATLSCRASQSVSRSYLAWYQQKPGQAPRLLIIGASTRATGIPDRFSGSGSGTDFTLTISRLEPEDFAVYYCQQGQVIPPTFGQGTKVEIK

SEQ ID NO: 11 - protein, 5 aa, Artificial Sequence
  FAP(4B9)  CDR-H1
SYAMS

SEQ ID NO: 12 - protein, 17 aa, Artificial Sequence
  FAP(4B9)  CDR-H2
AIIGSGASTYYADSVKG

SEQ ID NO: 13 - protein, 8 aa, Artificial Sequence
  FAP(4B9)  CDR-H3
GWFGGFNY

SEQ ID NO: 14 - protein, 12 aa, Artificial Sequence
  FAP(4B9)  CDR-L1
RASQSVSRSYLA

SEQ ID NO: 15 - protein, 7 aa, Artificial Sequence
  FAP(4B9)  CDR-L2
VGSRRAT

SEQ ID NO: 16 - protein, 9 aa, Artificial Sequence
  FAP(4B9)  CDR-L3
QQGIMLPPT

SEQ ID NO: 17 - protein, 117 aa, Artificial Sequence
  FAP(4B9)  VH
EVQLLESGGGLVQPGGSLRLSCAASGFTFSSYAMSWVRQAPGKGLEWVSAIIGSGASTYYADSVKGRFTISRDNSKNTLYLQMNSLRAEDTAVYYCAKGWFGGFNYWGQGTLVTVSS

SEQ ID NO: 18 - protein, 108 aa, Artificial Sequence
  FAP(4B9)  VL
EIVLTQSPGTLSLSPGERATLSCRASQSVTSSYLAWYQQKPGQAPRLLINVGSRRATGIPDRFSGSGSGTDFTLTISRLEPEDFAVYYCQQGIMLPPTFGQGTKVEIK

SEQ ID NO: 19 - protein, 5 aa, Artificial Sequence
  hu CD40  CDR-H1
GYYIH

SEQ ID NO: 20 - protein, 17 aa, Artificial Sequence
  hu CD40  CDR-H2
RVIPNAGGTSYNQKFKG

SEQ ID NO: 21 - protein, 5 aa, Artificial Sequence
  hu CD40  CDR-H3
EGIYW

SEQ ID NO: 22 - protein, 16 aa, Artificial Sequence
  hu CD40  CDR-L1
RSSQSLVHSNGNTFLH

SEQ ID NO: 23 - protein, 7 aa, Artificial Sequence
  hu CD40  CDR-L2
TVSNRFS

SEQ ID NO: 24 - protein, 9 aa, Artificial Sequence
  hu CD40  CDR-L3
SQTTHVPWT

SEQ ID NO: 25 - protein, 114 aa, Artificial Sequence [sequence omitted]

SEQ ID NO: 26 - protein, 112 aa, Artificial Sequence [sequence omitted]

SEQ ID NO: 27 - protein, 5 aa, Artificial Sequence
  mu CD40  CDR-H1
DYYMA

SEQ ID NO: 28 - protein, 17 aa, Artificial Sequence
  mu CD40  CDR-H2
SISYDGSSTYYRDSVKG

SEQ ID NO: 29 - protein, 7 aa, Artificial Sequence
  mu CD40  CDR-H3
HSSYFDY

SEQ ID NO: 30 - protein, 10 aa, Artificial Sequence
  mu CD40  CDR-L1
ASDSVSTLMH

SEQ ID NO: 31 - protein, 7 aa, Artificial Sequence
  mu CD40  CDR-L2
LASHLES

SEQ ID NO: 32 - protein, 9 aa, Artificial Sequence
  mu CD40  CDR-L3
QQSWNDPWT

SEQ ID NO: 33 - protein, 116 aa, Artificial Sequence
  mu CD40 VH
EVQLVESDGGLVQPGRSLKLPCAASGFTFSDYYMAWVRQAPTKGLEWVASISYDGSSTYYRDSVKGRFTISRDNAKSTLYLQMDSLRSEDTATYYCGRHSSYFDYWGQGVMVTVSS

SEQ ID NO: 34 - protein, 106 aa, Artificial Sequence
  mu CD40 VL
DTVLTQSPALAVSPGERVTISCRASDSVSTLMHWYQQKPGQQPKLLIYLASHLESGVPARFSGSGSGTDFTLTIDPVEADDTATYYCQQSWNDPWTFGGGTKLELK

SEQ ID NO: 35 - protein, 10 aa, Artificial Sequence
  hu CD40  CDR-H1 long
GYSFTGYYIH

SEQ ID NO: 36 - protein, 17 aa, Artificial Sequence
  hu CD40  CDR-H2 (hVH_1, hVH_2)
RVIPNNGGTSYNQKFKG

SEQ ID NO: 37 - protein, 17 aa, Artificial Sequence
  hu CD40  CDR-H2 (hVH_3)
RVIPNAGGTSYNQKFKG

SEQ ID NO: 38 - protein, 17 aa, Artificial Sequence
  hu CD40  CDR-H2 (hVH_4)
RVIPQAGGTSYNQKFKG

SEQ ID NO: 39 - protein, 17 aa, Artificial Sequence
  hu CD40  CDR-H2 (hVH_5)
RVIPNNGGTSYNQKFQG

SEQ ID NO: 40 - protein, 17 aa, Artificial Sequence
  hu CD40  CDR-H2 (hVH_6)
RVIPNNGGTSYAQKFKG

SEQ ID NO: 41 - protein, 17 aa, Artificial Sequence
  hu CD40  CDR-H2 (hVH_7)
RVIPNNGGTSYAQKFQG

SEQ ID NO: 42 - protein, 17 aa, Artificial Sequence
  hu CD40  CDR-H2 (hVH_5_N288A)
RVIPNAGGTSYNQKFQG

SEQ ID NO: 43 - protein, 17 aa, Artificial Sequence
  hu CD40  CDR-H2 (hVH_6_N288A)
RVIPNAGGTSYAQKFKG

SEQ ID NO: 44 - protein, 17 aa, Artificial Sequence
  hu CD40  CDR-H2 (hVH_7_N288A)
RVIPNAGGTSYAQKFQG

SEQ ID NO: 45 - protein, 114 aa, Artificial Sequence
  hu CD40 hVH_1
QVQLVQSGAEVKKPGASVKVSCKASGYSFTGYYIHWVRQAPGQGLEWMGRVIPNNGGTSYNQKFKGRVTSTRDTSISTAYMELSRLRSDDTVVYYCAREGIYWWGQGTTVTVSS

SEQ ID NO: 46 - protein, 114 aa, Artificial Sequence
  hu CD40 hVH_2
QVQLVQSGAEVKKPGASVKVSCKASGYSFTGYYIHWVRQAPGQGLEWIGRVIPNNGGTSYNQKFKGRVTSTVDTSISTAYMELSRLRSDDTVVYYCAREGIYWWGQGTTVTVSS

SEQ ID NO: 47 - protein, 114 aa, Artificial Sequence
  hu CD40 hVH_3
QVQLVQSGAEVKKPGASVKVSCKASGYSFTGYYIHWVRQAPGQGLEWIGRVIPNAGGTSYNQKFKGRVTSTVDTSISTAYMELSRLRSDDTVVYYCAREGIYWWGQGTTVTVSS

SEQ ID NO: 48 - protein, 114 aa, Artificial Sequence
  hu CD40 hVH_4
QVQLVQSGAEVKKPGASVKVSCKASGYSFTGYYIHWVRQAPGQGLEWIGRVIPQAGGTSYNQKFKGRVTSTVDTSISTAYMELSRLRSDDTVVYYCAREGIYWWGQGTTVTVSS

SEQ ID NO: 49 - protein, 114 aa, Artificial Sequence
  hu CD40 hVH_5
QVQLVQSGAEVKKPGASVKVSCKASGYSFTGYYIHWVRQAPGQGLEWIGRVIPNNGGTSYNQKFQGRVTSTVDTSISTAYMELSRLRSDDTVVYYCAREGIYWWGQGTTVTVSS

SEQ ID NO: 50 - protein, 114 aa, Artificial Sequence
  hu CD40 hVH_6
QVQLVQSGAEVKKPGASVKVSCKASGYSFTGYYIHWVRQAPGQGLEWIGRVIPNNGGTSYAQKFKGRVTSTVDTSISTAYMELSRLRSDDTVVYYCAREGIYWWGQGTTVTVSS

SEQ ID NO: 51 - protein, 114 aa, Artificial Sequence
  hu CD40 hVH_7
QVQLVQSGAEVKKPGASVKVSCKASGYSFTGYYIHWVRQAPGQGLEWIGRVIPNNGGTSYAQKFQGRVTSTVDTSISTAYMELSRLRSDDTVVYYCAREGIYWWGQGTTVTVSS

SEQ ID NO: 52 - protein, 114 aa, Artificial Sequence; identical to SEQ ID NO: 47
  hu CD40 hVH_2_N288A

SEQ ID NO: 53 - protein, 114 aa, Artificial Sequence
  hu CD40 hVH_5_N288A
QVQLVQSGAEVKKPGASVKVSCKASGYSFTGYYIHWVRQAPGQGLEWIGRVIPNAGGTSYNQKFQGRVTSTVDTSISTAYMELSRLRSDDTVVYYCAREGIYWWGQGTTVTVSS

SEQ ID NO: 54 - protein, 114 aa, Artificial Sequence
  hu CD40 hVH_6_N288A
QVQLVQSGAEVKKPGASVKVSCKASGYSFTGYYIHWVRQAPGQGLEWIGRVIPNAGGTSYAQKFKGRVTSTVDTSISTAYMELSRLRSDDTVVYYCAREGIYWWGQGTTVTVSS

SEQ ID NO: 55 - protein, 114 aa, Artificial Sequence
  hu CD40 hVH_7_N288A
QVQLVQSGAEVKKPGASVKVSCKASGYSFTGYYIHWVRQAPGQGLEWIGRVIPNAGGTSYAQKFQGRVTSTVDTSISTAYMELSRLRSDDTVVYYCAREGIYWWGQGTTVTVSS

SEQ ID NO: 56 - protein, 112 aa, Artificial Sequence
  hu CD40 hVK_1
DVVMTQSPLSLPVTLGQPASISCRSSQSLVHSNGNTFLHWFQQRPGQSPRRLIYTVSNRFSGVPDRFSGSGSGTDFTLKISRVEAEDVGVYYCSQTTHVPWTFGQGTKVEIK

SEQ ID NO: 57 - protein, 112 aa, Artificial Sequence
  hu CD40 hVK_2
DVVMTQSPLSLPVTLGQPASISCRSSQSLVHSNGNTFLHWYQQRPGQSPRLLIYTVSNRFSGVPDRFSGSGSGTDFTLKISRVEAEDVGVYYCSQTTHVPWTFGQGTKVEIK

SEQ ID NO: 58 - protein, 112 aa, Artificial Sequence
  hu CD40 hVK_3
DVVMTQSPLSLPVTLGQPASISCRSSQSLVHSNGNTFLHWYQQRPGQSPRLLIYTVSNRFSGVPDRFSGSGSGTDFTLKISRVEAEDVGVYFCSQTTHVPWTFGQGTKVEIK

SEQ ID NO: 59 - protein, 112 aa, Artificial Sequence
  hu CD40 hVK_4
DVVMTQSPLSLPVTLGQPASISCRSSQSLVHSNPNTFLHWYQQRPGQSPRLLIYTVSNRFSGVPDRFSGSGSGTDFTLKISRVEAEDVGVYFCSQTTHVPWTFGQGTKVEIK

SEQ ID NO: 60 - protein, 112 aa, Artificial Sequence
  hu CD40 hVK_5
DVVMTQSPLSLPVTLGQPASISCRSSQSLVHSNGNIFLHWYQQRPGQSPRLLIYTVSNRFSGVPDRFSGSGSGTDFTLKISRVEAEDVGVYFCSQTTHVPWTFGQGTKVEIK

SEQ ID NO: 61 - protein, 112 aa, Artificial Sequence
  hu CD40 hVK_6
DVVMTQSPLSLPVTLGQPASISCRSSQSLVHSNPNIFLHWYQQRPGQSPRLLIYTVSNRFSGVPDRFSGSGSGTDFTLKISRVEAEDVGVYFCSQTTHVPWTFGQGTKVEIK

SEQ ID NO: 62 - protein, 112 aa, Artificial Sequence
  hu CD40 hVK_7
DVVMTQSPLSLPVTLGQPASISCRSSQSLVHSQGNTFLHWYQQRPGQSPRLLIYTVSNRFSGVPDRFSGSGSGTDFTLKISRVEAEDVGVYFCSQTTHVPWTFGQGTKVEIK

SEQ ID NO: 63 - protein, 112 aa, Artificial Sequence
  hu CD40 hVK_8
DVVMTQSPLSLPVTLGQPASISCRSSQSLVHSNGQTFLHWYQQRPGQSPRLLIYTVSNRFSGVPDRFSGSGSGTDFTLKISRVEAEDVGVYFCSQTTHVPWTFGQGTKVEIK

SEQ ID NO: 64 - protein, 112 aa, Artificial Sequence
  hu CD40 hVK_9
DVVMTQSPLSLPVTLGQPASISCRSSQSLVHSQGQTFLHWYQQRPGQSPRLLIYTVSNRFSGVPDRFSGSGSGTDFTLKISRVEAEDVGVYFCSQTTHVPWTFGQGTKVEIK

SEQ ID NO: 65 - protein, 5 aa, Artificial Sequence
  DP47-CDR H1
SYAMS

SEQ ID NO: 66 - protein, 17 aa, Artificial Sequence
  DP47-CDR H2
AISGSGGSTYYADSVKG

SEQ ID NO: 67 - protein, 6 aa, Artificial Sequence
  DP47-CDR H3
GSGFDY

SEQ ID NO: 68 - protein, 12 aa, Artificial Sequence
  DP47-CDR L1
RASQSVSSSYLA

SEQ ID NO: 69 - protein, 7 aa, Artificial Sequence
  DP47-CDR L2
GASSRAT

SEQ ID NO: 70 - protein, 9 aa, Artificial Sequence
  DP47-CDR L3
QQYGSSPLT

SEQ ID NO: 71 - protein, 115 aa, Artificial Sequence
  DP47 VH
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGSGFDYWGQGTLVTVSS

SEQ ID NO: 72 - protein, 108 aa, Artificial Sequence
  DP47 VL
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGQGTKVEIK

SEQ ID NO: 73 - DNA, 342 bp, Artificial Sequence
  hu CD40 VH (nucleotide sequence)
gaggtgcagctggtggaatctggcggcggactggtgcagcctggcggatctctgagactgagctgtgccgccagcggctacagcttcaccggctactacatccactgggtgcgccaggcccctggcaagggactggaatgggtggccagagtgatccccaatgccggcggaaccagctacaaccagaagttcaagggccggttcaccctgagcgtggacaacagcaagaacaccgcctacctgcagatgaacagcctgcgggccgaggacaccgccgtgtactattgtgcccgcgagggcatctattggtggggccagggaacactcgtgaccgtgtccagc

SEQ ID NO: 74 - DNA, 336 bp, Artificial Sequence
  hu CD40 VL (nucleotide sequence)
gacatccagatgacccagagccccagcagcctgtctgccagcgtgggcgacagagtgaccatcacctgtcggagcagccagagcctggtgcacagcaacggcaacaccttcctgcactggtatcagcagaagcccggcaaggcccccaagctgctgatctacaccgtgtccaaccggttcagcggcgtgcccagcagattttctggcagcggctccggcaccgacttcaccctgacaatcagctccctgcagcccgaggacttcgccacctatttctgcagccagaccacccacgtgccctggacatttggacagggcaccaaggtggaaatcaag

SEQ ID NO: 75 - DNA, 348 bp, Artificial Sequence
  FAP 28H1 VH (nucleotide sequence)
gaggtgcagctgctggaatccggcggaggcctggtgcagcctggcggatctctgagactgtcctgcgccgcctccggcttcaccttctcctcccacgccatgtcctgggtccgacaggctcctggcaaaggcctggaatgggtgtccgccatctgggcctccggcgagcagtactacgccgactctgtgaagggccggttcaccatctcccgggacaactccaagaacaccctgtacctgcagatgaactccctgcgggccgaggacaccgccgtgtactactgtgccaagggctggctgggcaacttcgactactggggccagggcaccctggtcaccgtgtccagc

SEQ ID NO: 76 - DNA, 324 bp, Artificial Sequence
  FAP 28H1 VL (nucleotide sequence)
gagatcgtgctgacccagtctcccggcaccctgagcctgagccctggcgagagagccaccctgagctgcagagccagccagagcgtgagccggagctacctggcctggtatcagcagaagcccggccaggcccccagactgctgatcatcggcgccagcacccgggccaccggcatccccgatagattcagcggcagcggctccggcaccgacttcaccctgaccatcagccggctggaacccgaggacttcgccgtgtactactgccagcagggccaggtgatcccccccaccttcggccagggcaccaaggtggaaatcaag

SEQ ID NO: 77 - DNA, 345 bp, Artificial Sequence
  DP47 VH (nucleotide sequence)
gaggtgcaattgttggagtctgggggaggcttggtacagcctggggggtccctgagactctcctgtgcagccagcggattcacctttagcagttatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcagatgaacagcctgagagccgaggacacggccgtatattactgtgcgaaaggcagcggatttgactactggggccaaggaaccctggtcaccgtctcgagc

SEQ ID NO: 78 - DNA, 324 bp, Artificial Sequence
  DP47 VL(nucleotide sequence)
gaaattgtgctgacccagagccccggcaccctgtcactgtctccaggcgaaagagccaccctgagctgcagagccagccagagcgtgtccagctcttacctggcctggtatcagcagaagcccggacaggcccccagactgctgatctacggcgcctcttctagagccaccggcatccccgatagattcagcggcagcggctccggcaccgacttcaccctgacaatcagcagactggaacccgaggactttgccgtgtattactgccagcagtacggcagcagccccctgacctttggccagggcaccaaggtggaaatcaaa

SEQ ID NO: 79 - DNA, 348 bp, Artificial Sequence
  mu CD40 VH (nucleotide sequence)
gaagtgcagctggtggaatccgacggcggactggtgcagcctggcagatctctgaagctgccttgtgccgcctccggcttcaccttctccgactactacatggcctgggtgcgacaggcccctaccaagggactggaatgggtggcctccatctcctacgacggctcctccacctactaccgggactctgtgaagggccggttcaccatctctcgggacaacgccaagtccaccctgtacctgcagatggactccctgcggagcgaggacaccgctacctactactgcggcagacactcctcctacttcgactactggggccagggcgtgatggtcaccgtgtcctct

SEQ ID NO: 80 - DNA, 318 bp, Artificial Sequence
  mu CD40 VL (nucleotide sequence)
gacactgtactgacccagtctcctgctttggctgtgtctccaggagagagggttaccatctcctgtagggccagtgacagtgtcagtacacttatgcactggtaccaacagaaaccaggacagcaacccaaactcctcatctatctagcatcacacctagaatctggggtccctgccaggttcagtggcagtgggtctgggacagacttcaccctcaccattgatcctgtggaggctgatgacactgcaacctattactgtcagcagagttggaatgatccgtggacgttcggtggaggcaccaagctggaattgaaa

SEQ ID NO: 81 - protein, 443 aa, Artificial Sequence
  CD40 IgG heavy chain
EVQLVESGGGLVQPGGSLRLSCAASGYSFTGYYIHWVRQAPGKGLEWVARVIPNAGGTSYNQKFKGRFTLSVDNSKNTAYLQMNSLRAEDTAVYYCAREGIYWWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 82 - protein, 219 aa, Artificial Sequence
  CD40 light chain
DIQMTQSPSSLSASVGDRVTITCRSSQSLVHSNGNTFLHWYQQKPGKAPKLLIYTVSNRFSGVPSRFSGSGSGTDFTLTISSLQPEDFATYFCSQTTHVPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 83 - protein, 807 aa, Artificial Sequence
  CD40 VHCH1-CD40 VHCH1-Fcknob_PGLALA -28H1 VH
EVQLVESGGGLVQPGGSLRLSCAASGYSFTGYYIHWVRQAPGKGLEWVARVIPNAGGTSYNQKFKGRFTLSVDNSKNTAYLQMNSLRAEDTAVYYCAREGIYWWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDGGGGSGGGGSEVQLVESGGGLVQPGGSLRLSCAASGYSFTGYYIHWVRQAPGKGLEWVARVIPNAGGTSYNQKFKGRFTLSVDNSKNTAYLQMNSLRAEDTAVYYCAREGIYWWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEVQLLESGGGLVQPGGSLRLSCAASGFTFSSHAMSWVRQAPGKGLEWVSAIWASGEQYYADSVKGRFTISRDNSKNTLYLQMNSLRAEDTAVYYCAKGWLGNFDYWGQGTLVTVSS

SEQ ID NO: 84 - protein, 799 aa, Artificial Sequence
  CD40 VHCH1-CD40 VHCH1-Fchole_PGLALA-28H1 VL
EVQLVESGGGLVQPGGSLRLSCAASGYSFTGYYIHWVRQAPGKGLEWVARVIPNAGGTSYNQKFKGRFTLSVDNSKNTAYLQMNSLRAEDTAVYYCAREGIYWWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDGGGGSGGGGSEVQLVESGGGLVQPGGSLRLSCAASGYSFTGYYIHWVRQAPGKGLEWVARVIPNAGGTSYNQKFKGRFTLSVDNSKNTAYLQMNSLRAEDTAVYYCAREGIYWWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSGGGGSGGGGSEIVLTQSPGTLSLSPGERATLSCRASQSVSRSYLAWYQQKPGQAPRLLIIGASTRATGIPDRFSGSGSGTDFTLTISRLEPEDFAVYYCQQGQVIPPTFGQGTKVEIK

SEQ ID NO: 85 - protein, 904 aa, Artificial Sequence
  CD40 VHCH1-CD40 VHCH1-Fc_PGLALA-28H1 VLCH1 EE
EVQLVESGGGLVQPGGSLRLSCAASGYSFTGYYIHWVRQAPGKGLEWVARVIPNAGGTSYNQKFKGRFTLSVDNSKNTAYLQMNSLRAEDTAVYYCAREGIYWWGQGTLVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDGGGGSGGGGSEVQLVESGGGLVQPGGSLRLSCAASGYSFTGYYIHWVRQAPGKGLEWVARVIPNAGGTSYNQKFKGRFTLSVDNSKNTAYLQMNSLRAEDTAVYYCAREGIYWWGQGTLVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEIVLTQSPGTLSLSPGERATLSCRASQSVSRSYLAWYQQKPGQAPRLLIIGASTRATGIPDRFSGSGSGTDFTLTISRLEPEDFAVYYCQQGQVIPPTFGQGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 86 - protein, 219 aa, Artificial Sequence
  CD40 light chain RK
DIQMTQSPSSLSASVGDRVTITCRSSQSLVHSNGNTFLHWYQQKPGKAPKLLIYTVSNRFSGVPSRFSGSGSGTDFTLTISSLQPEDFATYFCSQTTHVPWTFGQGTKVEIKRTVAAPSVFIFPPSDRKLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 87 - protein, 223 aa, Artificial Sequence
  28H1 VHCL
EVQLLESGGGLVQPGGSLRLSCAASGFTFSSHAMSWVRQAPGKGLEWVSAIWASGEQYYADSVKGRFTISRDNSKNTLYLQMNSLRAEDTAVYYCAKGWLGNFDYWGQGTLVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 88 - protein, 571 aa, Artificial Sequence
  huCD40_Fchole_PGLALA_28H1 VL
EVQLVESGGGLVQPGGSLRLSCAASGYSFTGYYIHWVRQAPGKGLEWVARVIPNAGGTSYNQKFKGRFTLSVDNSKNTAYLQMNSLRAEDTAVYYCAREGIYWWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSGGGGSGGGGSEIVLTQSPGTLSLSPGERATLSCRASQSVSRSYLAWYQQKPGQAPRLLIIGASTRATGIPDRFSGSGSGTDFTLTISRLEPEDFAVYYCQQGQVIPPTFGQGTKVEIK

SEQ ID NO: 89 - protein, 579 aa, Artificial Sequence
  huCD40_Fcknob_PGLALA_28H1 VH
EVQLVESGGGLVQPGGSLRLSCAASGYSFTGYYIHWVRQAPGKGLEWVARVIPNAGGTSYNQKFKGRFTLSVDNSKNTAYLQMNSLRAEDTAVYYCAREGIYWWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEVQLLESGGGLVQPGGSLRLSCAASGFTFSSHAMSWVRQAPGKGLEWVSAIWASGEQYYADSVKGRFTISRDNSKNTLYLQMNSLRAEDTAVYYCAKGWLGNFDYWGQGTLVTVSS

SEQ ID NO: 90 - protein, 676 aa, Artificial Sequence
  huCD40-Fc_PGLALA_28H1_VLCH1 EE
EVQLVESGGGLVQPGGSLRLSCAASGYSFTGYYIHWVRQAPGKGLEWVARVIPNAGGTSYNQKFKGRFTLSVDNSKNTAYLQMNSLRAEDTAVYYCAREGIYWWGQGTLVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEIVLTQSPGTLSLSPGERATLSCRASQSVSRSYLAWYQQKPGQAPRLLIIGASTRATGIPDRFSGSGSGTDFTLTISRLEPEDFAVYYCQQGQVIPPTFGQGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 91 - protein, 806 aa, Artificial Sequence
  CD40 VHCH1-CD40 VHCH1-Fcknob_PGLALA-DP47 VH
EVQLVESGGGLVQPGGSLRLSCAASGYSFTGYYIHWVRQAPGKGLEWVARVIPNAGGTSYNQKFKGRFTLSVDNSKNTAYLQMNSLRAEDTAVYYCAREGIYWWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDGGGGSGGGGSEVQLVESGGGLVQPGGSLRLSCAASGYSFTGYYIHWVRQAPGKGLEWVARVIPNAGGTSYNQKFKGRFTLSVDNSKNTAYLQMNSLRAEDTAVYYCAREGIYWWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGSGFDYWGQGTLVTVSS

SEQ ID NO: 92 - protein, 799 aa, Artificial Sequence
  CD40 VHCH1-CD40 VHCH1-Fchole_PGLALA-DP47 VL
EVQLVESGGGLVQPGGSLRLSCAASGYSFTGYYIHWVRQAPGKGLEWVARVIPNAGGTSYNQKFKGRFTLSVDNSKNTAYLQMNSLRAEDTAVYYCAREGIYWWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDGGGGSGGGGSEVQLVESGGGLVQPGGSLRLSCAASGYSFTGYYIHWVRQAPGKGLEWVARVIPNAGGTSYNQKFKGRFTLSVDNSKNTAYLQMNSLRAEDTAVYYCAREGIYWWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGQGTKVEIK

SEQ ID NO: 93 - protein, 904 aa, Artificial Sequence
  CD40 VHCH1-CD40 VHCH1-Fc_PGLALA-DP47 VLCH1 EE
EVQLVESGGGLVQPGGSLRLSCAASGYSFTGYYIHWVRQAPGKGLEWVARVIPNAGGTSYNQKFKGRFTLSVDNSKNTAYLQMNSLRAEDTAVYYCAREGIYWWGQGTLVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDGGGGSGGGGSEVQLVESGGGLVQPGGSLRLSCAASGYSFTGYYIHWVRQAPGKGLEWVARVIPNAGGTSYNQKFKGRFTLSVDNSKNTAYLQMNSLRAEDTAVYYCAREGIYWWGQGTLVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGQGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 94 - protein, 222 aa, Artificial Sequence
  DP47VHCL
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGSGFDYWGQGTLVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 95 - protein, 803 aa, Artificial Sequence
  muCD40 VHCH1-muCD40 VHCH1-FcKK_DAPG -28H1 VH
EVQLVESDGGLVQPGRSLKLPCAASGFTFSDYYMAWVRQAPTKGLEWVASISYDGSSTYYRDSVKGRFTISRDNAKSTLYLQMDSLRSEDTATYYCGRHSSYFDYWGQGVMVTVSSAKTTPPSVYPLAPGSAAQTNSMVTLGCLVKGYFPEPVTVTWNSGSLSSGVHTFPAVLQSDLYTLSSSVTVPSSTWPSQTVTCNVAHPASSTKVDKKIVPRDCGGGGSGGGGSEVQLVESDGGLVQPGRSLKLPCAASGFTFSDYYMAWVRQAPTKGLEWVASISYDGSSTYYRDSVKGRFTISRDNAKSTLYLQMDSLRSEDTATYYCGRHSSYFDYWGQGVMVTVSSAKTTPPSVYPLAPGSAAQTNSMVTLGCLVKGYFPEPVTVTWNSGSLSSGVHTFPAVLQSDLYTLSSSVTVPSSTWPSQTVTCNVAHPASSTKVDKKIVPRDCGCKPCICTVPEVSSVFIFPPKPKDVLTITLTPKVTCVVVAISKDDPEVQFSWFVDDVEVHTAQTKPREEQINSTFRSVSELPIMHQDWLNGKEFKCRVNSAAFGAPIEKTISKTKGRPKAPQVYTIPPPKKQMAKDKVSLTCMITNFFPEDITVEWQWNGQPAENYKNTQPIMKTDGSYFVYSKLNVQKSNWEAGNTFTCSVLHEGLHNHHTEKSLSHSPGGGGGSGGGGSGGGGSGGGGSEVQLLESGGGLVQPGGSLRLSCAASGFTFSSHAMSWVRQAPGKGLEWVSAIWASGEQYYADSVKGRFTISRDNSKNTLYLQMNSLRAEDTAVYYCAKGWLGNFDYWGQGTLVTVSS

SEQ ID NO: 96 - protein, 795 aa, Artificial Sequence
  muCD40 VHCH1-muCD40 VHCH1-FcDD_DAPG -28H1 VL
EVQLVESDGGLVQPGRSLKLPCAASGFTFSDYYMAWVRQAPTKGLEWVASISYDGSSTYYRDSVKGRFTISRDNAKSTLYLQMDSLRSEDTATYYCGRHSSYFDYWGQGVMVTVSSAKTTPPSVYPLAPGSAAQTNSMVTLGCLVKGYFPEPVTVTWNSGSLSSGVHTFPAVLQSDLYTLSSSVTVPSSTWPSQTVTCNVAHPASSTKVDKKIVPRDCGGGGSGGGGSEVQLVESDGGLVQPGRSLKLPCAASGFTFSDYYMAWVRQAPTKGLEWVASISYDGSSTYYRDSVKGRFTISRDNAKSTLYLQMDSLRSEDTATYYCGRHSSYFDYWGQGVMVTVSSAKTTPPSVYPLAPGSAAQTNSMVTLGCLVKGYFPEPVTVTWNSGSLSSGVHTFPAVLQSDLYTLSSSVTVPSSTWPSQTVTCNVAHPASSTKVDKKIVPRDCGCKPCICTVPEVSSVFIFPPKPKDVLTITLTPKVTCVVVAISKDDPEVQFSWFVDDVEVHTAQTKPREEQINSTFRSVSELPIMHQDWLNGKEFKCRVNSAAFGAPIEKTISKTKGRPKAPQVYTIPPPKEQMAKDKVSLTCMITNFFPEDITVEWQWNGQPAENYDNTQPIMDTDGSYFVYSDLNVQKSNWEAGNTFTCSVLHEGLHNHHTEKSLSHSPGGGGGSGGGGSGGGGSGGGGSEIVLTQSPGTLSLSPGERATLSCRASQSVSRSYLAWYQQKPGQAPRLLIIGASTRATGIPDRFSGSGSGTDFTLTISRLEPEDFAVYYCQQGQVIPPTFGQGTKVEIK

SEQ ID NO: 97 - protein, 213 aa, Artificial Sequence
  mu CD40 light chain
DTVLTQSPALAVSPGERVTISCRASDSVSTLMHWYQQKPGQQPKLLIYLASHLESGVPARFSGSGSGTDFTLTIDPVEADDTATYYCQQSWNDPWTFGGGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 98 - protein, 900 aa, Artificial Sequence
  muCD40 VHCH1-muCD40 VHCH1-Fc_DAPG-28H1 VLCH1
EVQLVESDGGLVQPGRSLKLPCAASGFTFSDYYMAWVRQAPTKGLEWVASISYDGSSTYYRDSVKGRFTISRDNAKSTLYLQMDSLRSEDTATYYCGRHSSYFDYWGQGVMVTVSSAKTTPPSVYPLAPGSAAQTNSMVTLGCLVEGYFPEPVTVTWNSGSLSSGVHTFPAVLQSDLYTLSSSVTVPSSTWPSQTVTCNVAHPASSTKVDEKIVPRDCGGGGSGGGGSEVQLVESDGGLVQPGRSLKLPCAASGFTFSDYYMAWVRQAPTKGLEWVASISYDGSSTYYRDSVKGRFTISRDNAKSTLYLQMDSLRSEDTATYYCGRHSSYFDYWGQGVMVTVSSAKTTPPSVYPLAPGSAAQTNSMVTLGCLVEGYFPEPVTVTWNSGSLSSGVHTFPAVLQSDLYTLSSSVTVPSSTWPSQTVTCNVAHPASSTKVDEKIVPRDCGCKPCICTVPEVSSVFIFPPKPKDVLTITLTPKVTCVVVAISKDDPEVQFSWFVDDVEVHTAQTKPREEQINSTFRSVSELPIMHQDWLNGKEFKCRVNSAAFGAPIEKTISKTKGRPKAPQVYTIPPPKEQMAKDKVSLTCMITNFFPEDITVEWQWNGQPAENYKNTQPIMDTDGSYFVYSKLNVQKSNWEAGNTFTCSVLHEGLHNHHTEKSLSHSPGKGGGGSGGGGSGGGGSGGGGSEIVLTQSPGTLSLSPGERATLSCRASQSVSRSYLAWYQQKPGQAPRLLIIGASTRATGIPDRFSGSGSGTDFTLTISRLEPEDFAVYYCQQGQVIPPTFGQGTKVEIKSSAKTTPPSVYPLAPGSAAQTNSMVTLGCLVKGYFPEPVTVTWNSGSLSSGVHTFPAVLQSDLYTLSSSVTVPSSTWPSQTVTCNVAHPASSTKVDKKIVPRDC

SEQ ID NO: 99 - protein, 223 aa, Artificial Sequence
  28H1 VHCL (mu)
EVQLLESGGGLVQPGGSLRLSCAASGFTFSSHAMSWVRQAPGKGLEWVSAIWASGEQYYADSVKGRFTISRDNSKNTLYLQMNSLRAEDTAVYYCAKGWLGNFDYWGQGTLVTVSSASDAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 100 - protein, 213 aa, Artificial Sequence
  mu CD40 light chain; 'RK'
DTVLTQSPALAVSPGERVTISCRASDSVSTLMHWYQQKPGQQPKLLIYLASHLESGVPARFSGSGSGTDFTLTIDPVEADDTATYYCQQSWNDPWTFGGGTKLELKRADAAPTVSIFPPSSRKLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 101 - protein, 802 aa, Artificial Sequence
  muCD40 VHCH1-muCD40 VHCH1-FcKK_DAPG-DP47 VH
EVQLVESDGGLVQPGRSLKLPCAASGFTFSDYYMAWVRQAPTKGLEWVASISYDGSSTYYRDSVKGRFTISRDNAKSTLYLQMDSLRSEDTATYYCGRHSSYFDYWGQGVMVTVSSAKTTPPSVYPLAPGSAAQTNSMVTLGCLVKGYFPEPVTVTWNSGSLSSGVHTFPAVLQSDLYTLSSSVTVPSSTWPSQTVTCNVAHPASSTKVDKKIVPRDCGGGGSGGGGSEVQLVESDGGLVQPGRSLKLPCAASGFTFSDYYMAWVRQAPTKGLEWVASISYDGSSTYYRDSVKGRFTISRDNAKSTLYLQMDSLRSEDTATYYCGRHSSYFDYWGQGVMVTVSSAKTTPPSVYPLAPGSAAQTNSMVTLGCLVKGYFPEPVTVTWNSGSLSSGVHTFPAVLQSDLYTLSSSVTVPSSTWPSQTVTCNVAHPASSTKVDKKIVPRDCGCKPCICTVPEVSSVFIFPPKPKDVLTITLTPKVTCVVVAISKDDPEVQFSWFVDDVEVHTAQTKPREEQINSTFRSVSELPIMHQDWLNGKEFKCRVNSAAFGAPIEKTISKTKGRPKAPQVYTIPPPKKQMAKDKVSLTCMITNFFPEDITVEWQWNGQPAENYKNTQPIMKTDGSYFVYSKLNVQKSNWEAGNTFTCSVLHEGLHNHHTEKSLSHSPGGGGGSGGGGSGGGGSGGGGSEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGSGFDYWGQGTLVTVSS

SEQ ID NO: 102 - protein, 795 aa, Artificial Sequence
  muCD40 VHCH1-mu CD40 VHCH1-FcDD_DAPG-DP47 VL
EVQLVESDGGLVQPGRSLKLPCAASGFTFSDYYMAWVRQAPTKGLEWVASISYDGSSTYYRDSVKGRFTISRDNAKSTLYLQMDSLRSEDTATYYCGRHSSYFDYWGQGVMVTVSSAKTTPPSVYPLAPGSAAQTNSMVTLGCLVKGYFPEPVTVTWNSGSLSSGVHTFPAVLQSDLYTLSSSVTVPSSTWPSQTVTCNVAHPASSTKVDKKIVPRDCGGGGSGGGGSEVQLVESDGGLVQPGRSLKLPCAASGFTFSDYYMAWVRQAPTKGLEWVASISYDGSSTYYRDSVKGRFTISRDNAKSTLYLQMDSLRSEDTATYYCGRHSSYFDYWGQGVMVTVSSAKTTPPSVYPLAPGSAAQTNSMVTLGCLVKGYFPEPVTVTWNSGSLSSGVHTFPAVLQSDLYTLSSSVTVPSSTWPSQTVTCNVAHPASSTKVDKKIVPRDCGCKPCICTVPEVSSVFIFPPKPKDVLTITLTPKVTCVVVAISKDDPEVQFSWFVDDVEVHTAQTKPREEQINSTFRSVSELPIMHQDWLNGKEFKCRVNSAAFGAPIEKTISKTKGRPKAPQVYTIPPPKEQMAKDKVSLTCMITNFFPEDITVEWQWNGQPAENYDNTQPIMDTDGSYFVYSDLNVQKSNWEAGNTFTCSVLHEGLHNHHTEKSLSHSPGGGGGSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGQGTKVEIK

SEQ ID NO: 103 - protein, 900 aa, Artificial Sequence
  muCD40 VHCH1-muCD40 VHCH1-Fc_DAPG-28H1 VLCH1
EVQLVESDGGLVQPGRSLKLPCAASGFTFSDYYMAWVRQAPTKGLEWVASISYDGSSTYYRDSVKGRFTISRDNAKSTLYLQMDSLRSEDTATYYCGRHSSYFDYWGQGVMVTVSSAKTTPPSVYPLAPGSAAQTNSMVTLGCLVEGYFPEPVTVTWNSGSLSSGVHTFPAVLQSDLYTLSSSVTVPSSTWPSQTVTCNVAHPASSTKVDEKIVPRDCGGGGSGGGGSEVQLVESDGGLVQPGRSLKLPCAASGFTFSDYYMAWVRQAPTKGLEWVASISYDGSSTYYRDSVKGRFTISRDNAKSTLYLQMDSLRSEDTATYYCGRHSSYFDYWGQGVMVTVSSAKTTPPSVYPLAPGSAAQTNSMVTLGCLVEGYFPEPVTVTWNSGSLSSGVHTFPAVLQSDLYTLSSSVTVPSSTWPSQTVTCNVAHPASSTKVDEKIVPRDCGCKPCICTVPEVSSVFIFPPKPKDVLTITLTPKVTCVVVAISKDDPEVQFSWFVDDVEVHTAQTKPREEQINSTFRSVSELPIMHQDWLNGKEFKCRVNSAAFGAPIEKTISKTKGRPKAPQVYTIPPPKEQMAKDKVSLTCMITNFFPEDITVEWQWNGQPAENYKNTQPIMDTDGSYFVYSKLNVQKSNWEAGNTFTCSVLHEGLHNHHTEKSLSHSPGKGGGGSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGQGTKVEIKSSAKTTPPSVYPLAPGSAAQTNSMVTLGCLVKGYFPEPVTVTWNSGSLSSGVHTFPAVLQSDLYTLSSSVTVPSSTWPSQTVTCNVAHPASSTKVDKKIVPRDC

SEQ ID NO: 104 - protein, 222 aa, Artificial Sequence
  DP47 VHCL (mu)
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGSGFDYWGQGTLVTVSSASDAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 105 - DNA, 1332 bp, Artificial Sequence
  CD40 IgG heavy chain (nucleotide sequence)
gaggtgcagctggtggaatctggcggcggactggtgcagcctggcggatctctgagactgagctgtgccgccagcggctacagcttcaccggctactacatccactgggtgcgccaggcccctggcaagggactggaatgggtggccagagtgatccccaatgccggcggaaccagctacaaccagaagttcaagggccggttcaccctgagcgtggacaacagcaagaacaccgcctacctgcagatgaacagcctgcgggccgaggacaccgccgtgtactattgtgcccgcgagggcatctattggtggggccagggaacactcgtgaccgtgtccagcgctagcaccaagggcccaagcgtgttcccactggccccaagcagcaagtctaccagcggaggaacagccgccctgggatgtctggtgaaggactacttccccgagccagtgacagtgagctggaactctggcgccctgacatctggcgtgcacacattcccagccgtgctgcagtctagcggcctgtacagcctgtccagcgtggtgacagtgccaagcagctctctgggcacccagacctacatctgcaacgtgaaccacaagcccagcaacaccaaggtggacaagaaggtggagcccaagagctgcgacaagacccacacctgcccaccatgtccagccccagagctgctgggaggacctagcgtgttcctgttcccccccaagccaaaggacaccctgatgatcagcagaacccccgaggtgacatgtgtggtggtggacgtgtctcacgaggacccagaggtgaagttcaactggtacgtggacggagtggaggtgcacaacgccaagaccaagcccagagaggagcagtacaacagcacctaccgcgtggtgtctgtgctgacagtgctgcaccaggactggctgaacggcaaagaatacaagtgcaaggtctccaacaaggccctgccagccccaatcgaaaagaccatcagcaaggccaagggccagccaagggagccacaggtgtacaccctgcccccatctagggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 106 - DNA, 657 bp, Artificial Sequence
  CD40 light chain (nucleotide sequence)
gacatccagatgacccagagccccagcagcctgtctgccagcgtgggcgacagagtgaccatcacctgtcggagcagccagagcctggtgcacagcaacggcaacaccttcctgcactggtatcagcagaagcccggcaaggcccccaagctgctgatctacaccgtgtccaaccggttcagcggcgtgcccagcagattttctggcagcggctccggcaccgacttcaccctgacaatcagctccctgcagcccgaggacttcgccacctatttctgcagccagaccacccacgtgccctggacatttggacagggcaccaaggtggaaatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 107 - DNA, 2421 bp, Artificial Sequence
  CD40 VHCH1-CD40 VHCH1-Fcknob_PGLALA -28H1 VH
gaggtgcagctggtggaatctggcggcggactggtgcagcctggcggatctctgagactgagctgtgccgccagcggctacagcttcaccggctactacatccactgggtgcgccaggcccctggcaagggactggaatgggtggccagagtgatccccaatgccggcggaaccagctacaaccagaagttcaagggccggttcaccctgagcgtggacaacagcaagaacaccgcctacctgcagatgaacagcctgcgggccgaggacaccgccgtgtactattgtgcccgcgagggcatctattggtggggccagggaacactcgtgaccgtgtccagcgcttccaccaagggccctagcgtgttccctctggcccctagcagcaagtctaccagcggaggaacagccgccctgggctgcctcgtgaaggactactttcccgagcccgtgacagtgtcctggaactctggcgccctgacaagcggcgtgcacacctttccagccgtgctgcagagcagcggcctgtactctctgagcagcgtcgtgactgtgcccagcagcagcctgggaacccagacctacatctgcaacgtgaaccacaagcccagcaacaccaaggtggacaagaaggtggaacccaagagctgcgacggcggaggcggatcaggcggcggaggatccgaagtgcagctggtggaaagtgggggaggcctggtgcagccagggggaagcctgagactgtcttgtgccgcttccggctactcttttaccgggtattatatccattgggtgcggcaggctccagggaaaggcctggaatgggtggcacgcgtgatccctaacgcaggcggcacctcttataatcagaagtttaaagggcgctttaccctgtccgtggacaattccaagaatactgcttacctgcagatgaattccctgcgcgccgaagatacagctgtgtattactgcgccagagaagggatctattggtggggacagggcaccctcgtgacagtgtcatccgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccctgcagagatgagctgaccaagaaccaggtgtccctgtggtgtctggtcaagggcttctaccccagcgatatcgccgtggagtgggagagcaacggccagcctgagaacaactacaagaccaccccccctgtgctggacagcgacggcagcttcttcctgtactccaaactgaccgtggacaagagccggtggcagcagggcaacgtgttcagctgcagcgtgatgcacgaggccctgcacaaccactacacccagaagtccctgagcctgagccccggcggaggcggcggaagcggaggaggaggatccggaggagggggaagtggcggcggaggatctgaggtgcagctgctggaatccggcggaggcctggtgcagcctggcggatctctgagactgtcctgcgccgcctccggcttcaccttctcctcccacgccatgtcctgggtccgacaggctcctggcaaaggcctggaatgggtgtccgccatctgggcctccggcgagcagtactacgccgactctgtgaagggccggttcaccatctcccgggacaactccaagaacaccctgtacctgcagatgaactccctgcgggccgaggacaccgccgtgtactactgtgccaagggctggctgggcaacttcgactactggggccagggcaccctggtcaccgtgtccagc

SEQ ID NO: 108 - DNA, 2397 bp, Artificial Sequence
  CD40 VHCH1-CD40 VHCH1-Fchole_PGLALA-28H1 VL
gaggtgcagctggtggaatctggcggcggactggtgcagcctggcggatctctgagactgagctgtgccgccagcggctacagcttcaccggctactacatccactgggtgcgccaggcccctggcaagggactggaatgggtggccagagtgatccccaatgccggcggaaccagctacaaccagaagttcaagggccggttcaccctgagcgtggacaacagcaagaacaccgcctacctgcagatgaacagcctgcgggccgaggacaccgccgtgtactattgtgcccgcgagggcatctattggtggggccagggaacactcgtgaccgtgtccagcgcttccaccaagggccctagcgtgttccctctggcccctagcagcaagtctaccagcggaggaacagccgccctgggctgcctcgtgaaggactactttcccgagcccgtgacagtgtcctggaactctggcgccctgacaagcggcgtgcacacctttccagccgtgctgcagagcagcggcctgtactctctgagcagcgtcgtgactgtgcccagcagcagcctgggaacccagacctacatctgcaacgtgaaccacaagcccagcaacaccaaggtggacaagaaggtggaacccaagagctgcgacggcggaggcggatcaggcggcggaggatccgaagtgcagctggtggaaagtgggggaggcctggtgcagccagggggaagcctgagactgtcttgtgccgcttccggctactcttttaccgggtattatatccattgggtgcggcaggctccagggaaaggcctggaatgggtggcacgcgtgatccctaacgcaggcggcacctcttataatcagaagtttaaagggcgctttaccctgtccgtggacaattccaagaatactgcttacctgcagatgaattccctgcgcgccgaagatacagctgtgtattactgcgccagagaagggatctattggtggggacagggcaccctcgtgacagtgtcatccgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtggaggcggcggaagcggaggaggaggatccggtggtggcggatctgggggcggtggatctgagatcgtgctgacccagtctcccggcaccctgagcctgagccctggcgagagagccaccctgagctgcagagccagccagagcgtgagccggagctacctggcctggtatcagcagaagcccggccaggcccccagactgctgatcatcggcgccagcacccgggccaccggcatccccgatagattcagcggcagcggctccggcaccgacttcaccctgaccatcagccggctggaacccgaggacttcgccgtgtactactgccagcagggccaggtgatcccccccaccttcggccagggcaccaaggtggaaatcaag

SEQ ID NO: 109 - DNA, 2712 bp, Artificial Sequence
  CD40 VHCH1-CD40 VHCH1-Fc_PGLALA-28H1 VLCH1 EE
gaggtgcagctggtggaatctggcggcggactggtgcagcctggcggatctctgagactgagctgtgccgccagcggctacagcttcaccggctactacatccactgggtgcgccaggcccctggcaagggactggaatgggtggccagagtgatccccaatgccggcggaaccagctacaaccagaagttcaagggccggttcaccctgagcgtggacaacagcaagaacaccgcctacctgcagatgaacagcctgcgggccgaggacaccgccgtgtactattgtgcccgcgagggcatctattggtggggccagggaacactcgtgaccgtgtccagcgcttctaccaagggccccagcgtgttccctctggcccctagcagcaagagcacatctggcggaacagccgccctgggctgcctcgtggaggactactttcccgagcccgtgacagtgtcctggaactctggcgccctgacaagcggcgtgcacacctttccagccgtgctccagagcagcggcctgtactctctgagcagcgtcgtgactgtgcccagcagcagcctgggaacccagacctacatctgcaacgtgaaccacaagcccagcaacaccaaggtggacgagaaggtggaacccaagagctgcgacggcggaggcggatctggcggcggaggatccgaagtgcagctggtggaaagtgggggaggcctggtgcagccagggggaagcctgagactgtcttgtgccgcttccggctactcttttaccgggtattatatccattgggtgcggcaggctccagggaaaggcctggaatgggtggcacgcgtgatccctaacgcaggcggcacctcttataatcagaagtttaaagggcgctttaccctgtccgtggacaattccaagaatactgcttacctgcagatgaattccctgcgcgccgaagatacagctgtgtattactgcgccagagaagggatctattggtggggacagggcaccctcgtgacagtgtcatccgctagcaccaagggaccttccgtgtttcccctggctcccagctccaagtctacctctgggggcacagctgctctgggatgtctggtggaagattattttcctgaacctgtgaccgtgtcatggaacagcggagccctgacctccggggtgcacacattccctgctgtgctgcagtcctccggcctgtatagcctgagcagcgtcgtgaccgtgccttccagctctctgggcacacagacatatatctgtaatgtgaatcacaaaccctctaataccaaagtggatgagaaagtggaacctaagtcctgcgacaagacccacacctgtcccccttgtcctgcccctgaagctgctggcggcccatctgtgtttctgttccccccaaagcccaaggacaccctgatgatcagccggacccccgaagtgacctgcgtggtggtggatgtgtcccacgaggacccagaagtgaagttcaattggtacgtggacggcgtggaagtgcacaacgccaagaccaagccgcgggaagaacagtacaacagcacctaccgggtggtgtccgtgctgacagtgctgcaccaggactggctgaacggcaaagagtacaagtgcaaggtgtccaacaaggccctgggagcccccatcgagaaaaccatcagcaaggccaagggccagccccgcgaacctcaggtgtacaccctgcccccaagcagggacgagctgaccaagaaccaggtgtccctgacctgtctcgtgaagggcttctacccctccgatatcgccgtggaatgggagagcaacggccagcccgagaacaactacaagaccaccccccctgtgctggacagcgacggctcattcttcctgtactccaagctgaccgtggacaagagccggtggcagcagggcaacgtgttcagctgcagcgtgatgcacgaggccctgcacaaccactacacacagaagtctctgagcctgagccctggcggagggggaggatctgggggaggcggaagtgggggagggggttccggaggcggcggatcagaaattgtgctgacccagtcccccggcaccctgtcactgtctccaggcgaaagagccaccctgagctgtagggcctcccagagcgtgtccagaagctatctggcctggtatcagcagaagcccggacaggcccccagactgctgatcattggcgcctctaccagagccaccggcatccccgatagattcagcggctctggcagcggcaccgacttcaccctgaccatctccagactggaacccgaggactttgccgtgtactattgccagcagggccaagtgatcccccccacctttggccagggaacaaaggtggaaatcaagtccagcgcttccaccaagggcccctcagtgttcccactggcaccatccagcaagtccacaagcggaggaaccgccgctctgggctgtctcgtgaaagactactttccagagccagtgaccgtgtcctggaatagtggcgctctgacttctggcgtgcacactttccccgcagtgctgcagagttctggcctgtactccctgagtagcgtcgtgacagtgccctcctctagcctgggcactcagacttacatctgcaatgtgaatcataagccttccaacacaaaagtggacaaaaaagtggaacccaaatcttgc

SEQ ID NO: 110 - DNA, 657 bp, Artificial Sequence
  CD40 light chain RK
gacatccagatgacccagagccccagcagcctgtctgccagcgtgggcgacagagtgaccatcacctgtcggagcagccagagcctggtgcacagcaacggcaacaccttcctgcactggtatcagcagaagcccggcaaggcccccaagctgctgatctacaccgtgtccaaccggttcagcggcgtgcccagcagattttctggcagcggctccggcaccgacttcaccctgacaatcagctccctgcagcccgaggacttcgccacctatttctgcagccagaccacccacgtgccctggacatttggacagggcaccaaggtggaaatcaagcgtacggtggctgcaccatctgtcttcatcttcccgccatctgatcggaagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 111 - DNA, 669 bp, Artificial Sequence
  28H1 VHCL
gaagtgcagctgctggaatccggcggaggcctggtgcagcctggcggatctctgagactgtcctgcgccgcctccggcttcaccttctcctcccacgccatgtcctgggtccgacaggctcctggcaaaggcctggaatgggtgtccgccatctgggcctccggcgagcagtactacgccgactctgtgaagggccggttcaccatctcccgggacaactccaagaacaccctgtacctgcagatgaactccctgcgggccgaggacaccgccgtgtactactgtgccaagggctggctgggcaacttcgactactggggacagggcaccctggtcaccgtgtccagcgctagcgtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaacagccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgc

SEQ ID NO: 112 - DNA, 1716 bp, Artificial Sequence
  huCD40_Fchole_PGLALA_28H1 VL
gaggtgcagctggtggaatctggcggcggactggtgcagcctggcggatctctgagactgagctgtgccgccagcggctacagcttcaccggctactacatccactgggtgcgccaggcccctggcaagggactggaatgggtggccagagtgatccccaatgccggcggaaccagctacaaccagaagttcaagggccggttcaccctgagcgtggacaacagcaagaacaccgcctacctgcagatgaacagcctgcgggccgaggacaccgccgtgtactattgtgcccgcgagggcatctattggtggggccagggaacactcgtgaccgtgtccagcgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtggaggcggcggaagcggaggaggaggatccggtggtggcggatctgggggcggtggatctgagatcgtgctgacccagtctcccggcaccctgagcctgagccctggcgagagagccaccctgagctgcagagccagccagagcgtgagccggagctacctggcctggtatcagcagaagcccggccaggcccccagactgctgatcatcggcgccagcacccgggccaccggcatccccgatagattcagcggcagcggctccggcaccgacttcaccctgaccatcagccggctggaacccgaggacttcgccgtgtactactgccagcagggccaggtgatcccccccaccttcggccagggcaccaaggtggaaatcaagtga

SEQ ID NO: 113 - DNA, 1740 bp, Artificial Sequence
  huCD40_Fcknob_PGLALA_28H1 VH
gaggtgcagctggtggaatctggcggcggactggtgcagcctggcggatctctgagactgagctgtgccgccagcggctacagcttcaccggctactacatccactgggtgcgccaggcccctggcaagggactggaatgggtggccagagtgatccccaatgccggcggaaccagctacaaccagaagttcaagggccggttcaccctgagcgtggacaacagcaagaacaccgcctacctgcagatgaacagcctgcgggccgaggacaccgccgtgtactattgtgcccgcgagggcatctattggtggggccagggaacactcgtgaccgtgtccagcgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccctgcagagatgagctgaccaagaaccaggtgtccctgtggtgtctggtcaagggcttctaccccagcgatatcgccgtggagtgggagagcaacggccagcctgagaacaactacaagaccaccccccctgtgctggacagcgacggcagcttcttcctgtactccaaactgaccgtggacaagagccggtggcagcagggcaacgtgttcagctgcagcgtgatgcacgaggccctgcacaaccactacacccagaagtccctgagcctgagccccggcggaggcggcggaagcggaggaggaggatccggaggagggggaagtggcggcggaggatctgaggtgcagctgctggaatccggcggaggcctggtgcagcctggcggatctctgagactgtcctgcgccgcctccggcttcaccttctcctcccacgccatgtcctgggtccgacaggctcctggcaaaggcctggaatgggtgtccgccatctgggcctccggcgagcagtactacgccgactctgtgaagggccggttcaccatctcccgggacaactccaagaacaccctgtacctgcagatgaactccctgcgggccgaggacaccgccgtgtactactgtgccaagggctggctgggcaacttcgactactggggccagggcaccctggtcaccgtgtccagctga

SEQ ID NO: 114 - DNA, 2031 bp, Artificial Sequence
  huCD40-Fc_PGLALA_28H1_VLCH1 EE
gaggtgcagctggtggaatctggcggcggactggtgcagcctggcggatctctgagactgagctgtgccgccagcggctacagcttcaccggctactacatccactgggtgcgccaggcccctggcaagggactggaatgggtggccagagtgatccccaatgccggcggaaccagctacaaccagaagttcaagggccggttcaccctgagcgtggacaacagcaagaacaccgcctacctgcagatgaacagcctgcgggccgaggacaccgccgtgtactattgtgcccgcgagggcatctattggtggggccagggaacactcgtgaccgtgtccagcgctagcaccaagggaccttccgtgtttcccctggctcccagctccaagtctacctctgggggcacagctgctctgggatgtctggtggaagattattttcctgaacctgtgaccgtgtcatggaacagcggagccctgacctccggggtgcacacattccctgctgtgctgcagtcctccggcctgtatagcctgagcagcgtcgtgaccgtgccttccagctctctgggcacacagacatatatctgtaatgtgaatcacaaaccctctaataccaaagtggatgagaaagtggaacctaagtcctgcgacaagacccacacctgtcccccttgtcctgcccctgaagctgctggcggcccatctgtgtttctgttccccccaaagcccaaggacaccctgatgatcagccggacccccgaagtgacctgcgtggtggtggatgtgtcccacgaggacccagaagtgaagttcaattggtacgtggacggcgtggaagtgcacaacgccaagaccaagccgcgggaagaacagtacaacagcacctaccgggtggtgtccgtgctgacagtgctgcaccaggactggctgaacggcaaagagtacaagtgcaaggtgtccaacaaggccctgggagcccccatcgagaaaaccatcagcaaggccaagggccagccccgcgaacctcaggtgtacaccctgcccccaagcagggacgagctgaccaagaaccaggtgtccctgacctgtctcgtgaagggcttctacccctccgatatcgccgtggaatgggagagcaacggccagcccgagaacaactacaagaccaccccccctgtgctggacagcgacggctcattcttcctgtactccaagctgaccgtggacaagagccggtggcagcagggcaacgtgttcagctgcagcgtgatgcacgaggccctgcacaaccactacacacagaagtctctgagcctgagccctggcggagggggaggatctgggggaggcggaagtgggggagggggttccggaggcggcggatcagaaattgtgctgacccagtcccccggcaccctgtcactgtctccaggcgaaagagccaccctgagctgtagggcctcccagagcgtgtccagaagctatctggcctggtatcagcagaagcccggacaggcccccagactgctgatcattggcgcctctaccagagccaccggcatccccgatagattcagcggctctggcagcggcaccgacttcaccctgaccatctccagactggaacccgaggactttgccgtgtactattgccagcagggccaagtgatcccccccacctttggccagggaacaaaggtggaaatcaagtccagcgcttccaccaagggcccctcagtgttcccactggcaccatccagcaagtccacaagcggaggaaccgccgctctgggctgtctcgtgaaagactactttccagagccagtgaccgtgtcctggaatagtggcgctctgacttctggcgtgcacactttccccgcagtgctgcagagttctggcctgtactccctgagtagcgtcgtgacagtgccctcctctagcctgggcactcagacttacatctgcaatgtgaatcataagccttccaacacaaaagtggacaaaaaagtggaacccaaatcttgctga

SEQ ID NO: 115 - DNA, 2418 bp, Artificial Sequence
  CD40 VHCH1-CD40 VHCH1-Fcknob_PGLALA-DP47 VH
gaggtgcagctggtggaatctggcggcggactggtgcagcctggcggatctctgagactgagctgtgccgccagcggctacagcttcaccggctactacatccactgggtgcgccaggcccctggcaagggactggaatgggtggccagagtgatccccaatgccggcggaaccagctacaaccagaagttcaagggccggttcaccctgagcgtggacaacagcaagaacaccgcctacctgcagatgaacagcctgcgggccgaggacaccgccgtgtactattgtgcccgcgagggcatctattggtggggccagggaacactcgtgaccgtgtccagcgcttccaccaagggccctagcgtgttccctctggcccctagcagcaagtctaccagcggaggaacagccgccctgggctgcctcgtgaaggactactttcccgagcccgtgacagtgtcctggaactctggcgccctgacaagcggcgtgcacacctttccagccgtgctgcagagcagcggcctgtactctctgagcagcgtcgtgactgtgcccagcagcagcctgggaacccagacctacatctgcaacgtgaaccacaagcccagcaacaccaaggtggacaagaaggtggaacccaagagctgcgacggcggaggcggatcaggcggcggaggatccgaagtgcagctggtggaaagtgggggaggcctggtgcagccagggggaagcctgagactgtcttgtgccgcttccggctactcttttaccgggtattatatccattgggtgcggcaggctccagggaaaggcctggaatgggtggcacgcgtgatccctaacgcaggcggcacctcttataatcagaagtttaaagggcgctttaccctgtccgtggacaattccaagaatactgcttacctgcagatgaattccctgcgcgccgaagatacagctgtgtattactgcgccagagaagggatctattggtggggacagggcaccctcgtgacagtgtcatccgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccctgcagagatgagctgaccaagaaccaggtgtccctgtggtgtctggtcaagggcttctaccccagcgatatcgccgtggagtgggagagcaacggccagcctgagaacaactacaagaccaccccccctgtgctggacagcgacggcagcttcttcctgtactccaaactgaccgtggacaagagccggtggcagcagggcaacgtgttcagctgcagcgtgatgcacgaggccctgcacaaccactacacccagaagtccctgagcctgagccccggcggaggcggcggaagcggaggaggaggatccggaggagggggaagtggcggcggaggatctgaggtgcaattgttggagtctgggggaggcttggtacagcctggggggtccctgagactctcctgtgcagccagcggattcacctttagcagttatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcagatgaacagcctgagagccgaggacacggccgtatattactgtgcgaaaggcagcggatttgactactggggccaaggaaccctggtcaccgtctcgagc

SEQ ID NO: 116 - DNA, 2397 bp, Artificial Sequence
  CD40 VHCH1-CD40 VHCH1-Fc hole_PGLALA-DP47 VL DNA
gaggtgcagctggtggagagcggcggcggcctggtgcagcccggcggcagcctgaggctgagctgcgccgccagcggctacagcttcaccggctactacatccactgggtgaggcaggcccccggcaagggcctggagtgggtggccagggtgatccccaacgccggcggcaccagctacaaccagaagttcaagggcaggttcaccctgagcgtggacaacagcaagaacaccgcctacctgcagatgaacagcctgagggccgaggacaccgccgtgtactactgcgccagggagggcatctactggtggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacggcggcggcggcagcggcggcggcggcagcgaggtgcagctggtggagagcggcggcggcctggtgcagcccggcggcagcctgaggctgagctgcgccgccagcggctacagcttcaccggctactacatccactgggtgaggcaggcccccggcaagggcctggagtgggtggccagggtgatccccaacgccggcggcaccagctacaaccagaagttcaagggcaggttcaccctgagcgtggacaacagcaagaacaccgcctacctgcagatgaacagcctgagggccgaggacaccgccgtgtactactgcgccagggagggcatctactggtggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgaggccgccggcggccccagcgtgttcctgttcccccccaagcccaaggacaccctgatgatcagcaggacccccgaggtgacctgcgtggtggtggacgtgagccacgaggaccccgaggtgaagttcaactggtacgtggacggcgtggaggtgcacaacgccaagaccaagcccagggaggagcagtacaacagcacctacagggtggtgagcgtgctgaccgtgctgcaccaggactggctgaacggcaaggagtacaagtgcaaggtgagcaacaaggccctgggcgcccccatcgagaagaccatcagcaaggccaagggccagcccagggagccccaggtgtgcaccctgccccccagcagggacgagctgaccaagaaccaggtgagcctgagctgcgccgtgaagggcttctaccccagcgacatcgccgtggagtgggagagcaacggccagcccgagaacaactacaagaccaccccccccgtgctggacagcgacggcagcttcttcctggtgagcaagctgaccgtggacaagagcaggtggcagcagggcaacgtgttcagctgcagcgtgatgcacgaggccctgcacaaccactacacccagaagagcctgagcctgagccccggcggcggcggcggcagcggcggcggcggcagcggcggcggcggcagcggcggcggcggcagcgagatcgtgctgacccagagccccggcaccctgagcctgagccccggcgagagggccaccctgagctgcagggccagccagagcgtgagcagcagctacctggcctggtaccagcagaagcccggccaggcccccaggctgctgatctacggcgccagcagcagggccaccggcatccccgacaggttcagcggcagcggcagcggcaccgacttcaccctgaccatcagcaggctggagcccgaggacttcgccgtgtactactgccagcagtacggcagcagccccctgaccttcggccagggcaccaaggtggagatcaag

SEQ ID NO: 117 - DNA, 2712 bp, Artificial Sequence
  CD40 VHCH1-CD40 VHCH1-Fc_PGLALA-DP47 VLCH1 EE
gaggtgcagctggtggaatctggcggcggactggtgcagcctggcggatctctgagactgagctgtgccgccagcggctacagcttcaccggctactacatccactgggtgcgccaggcccctggcaagggactggaatgggtggccagagtgatccccaatgccggcggaaccagctacaaccagaagttcaagggccggttcaccctgagcgtggacaacagcaagaacaccgcctacctgcagatgaacagcctgcgggccgaggacaccgccgtgtactattgtgcccgcgagggcatctattggtggggccagggaacactcgtgaccgtgtccagcgcttctaccaagggccccagcgtgttccctctggcccctagcagcaagagcacatctggcggaacagccgccctgggctgcctcgtggaggactactttcccgagcccgtgacagtgtcctggaactctggcgccctgacaagcggcgtgcacacctttccagccgtgctccagagcagcggcctgtactctctgagcagcgtcgtgactgtgcccagcagcagcctgggaacccagacctacatctgcaacgtgaaccacaagcccagcaacaccaaggtggacgagaaggtggaacccaagagctgcgacggcggaggcggatctggcggcggaggatccgaagtgcagctggtggaaagtgggggaggcctggtgcagccagggggaagcctgagactgtcttgtgccgcttccggctactcttttaccgggtattatatccattgggtgcggcaggctccagggaaaggcctggaatgggtggcacgcgtgatccctaacgcaggcggcacctcttataatcagaagtttaaagggcgctttaccctgtccgtggacaattccaagaatactgcttacctgcagatgaattccctgcgcgccgaagatacagctgtgtattactgcgccagagaagggatctattggtggggacagggcaccctcgtgacagtgtcatccgctagcaccaagggaccttccgtgtttcccctggctcccagctccaagtctacctctgggggcacagctgctctgggatgtctggtggaagattattttcctgaacctgtgaccgtgtcatggaacagcggagccctgacctccggggtgcacacattccctgctgtgctgcagtcctccggcctgtatagcctgagcagcgtcgtgaccgtgccttccagctctctgggcacacagacatatatctgtaatgtgaatcacaaaccctctaataccaaagtggatgagaaagtggaacctaagtcctgcgacaagacccacacctgtcccccttgtcctgcccctgaagctgctggcggcccatctgtgtttctgttccccccaaagcccaaggacaccctgatgatcagccggacccccgaagtgacctgcgtggtggtggatgtgtcccacgaggacccagaagtgaagttcaattggtacgtggacggcgtggaagtgcacaacgccaagaccaagccgcgggaagaacagtacaacagcacctaccgggtggtgtccgtgctgacagtgctgcaccaggactggctgaacggcaaagagtacaagtgcaaggtgtccaacaaggccctgggagcccccatcgagaaaaccatcagcaaggccaagggccagccccgcgaacctcaggtgtacaccctgcccccaagcagggacgagctgaccaagaaccaggtgtccctgacctgtctcgtgaagggcttctacccctccgatatcgccgtggaatgggagagcaacggccagcccgagaacaactacaagaccaccccccctgtgctggacagcgacggctcattcttcctgtactccaagctgaccgtggacaagagccggtggcagcagggcaacgtgttcagctgcagcgtgatgcacgaggccctgcacaaccactacacacagaagtctctgagcctgagccctggcggagggggaggatctgggggaggcggaagtgggggagggggttccggaggcggaggatccgaaatcgtgttaacgcagtctccaggcaccctgtctttgtctccaggggaaagagccaccctctcttgcagggccagtcagagtgttagcagcagctacttagcctggtaccagcagaaacctggccaggctcccaggctcctcatctatggagcatccagcagggccactggcatcccagacaggttcagtggcagtggatccgggacagacttcactctcaccatcagcagactggagcctgaagattttgcagtgtattactgtcagcagtatggtagctcaccgctgacgttcggccaggggaccaaagtggaaatcaaaagcagcgcttccaccaagggcccctcagtgttcccactggcaccatccagcaagtccacaagcggaggaaccgccgctctgggctgtctcgtgaaagactactttccagagccagtgaccgtgtcctggaatagtggcgctctgacttctggcgtgcacactttccccgcagtgctgcagagttctggcctgtactccctgagtagcgtcgtgacagtgccctcctctagcctgggcactcagacttacatctgcaatgtgaatcataagccttccaacacaaaagtggacaaaaaagtggaacccaaatcttgc

SEQ ID NO: 118 - DNA, 666 bp, Artificial Sequence
  DP47 VHCL
gaggtgcaattgttggagtctgggggaggcttggtacagcctggggggtccctgagactctcctgtgcagcctccggattcacctttagcagttatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcagatgaacagcctgagagccgaggacacggccgtatattactgtgcgaaaggcagcggatttgactactggggccaaggaaccctggtcaccgtctcgagtgctagcgtggccgctccctccgtgttcatcttcccaccttccgacgagcagctgaagtccggcaccgcttctgtcgtgtgcctgctgaacaacttctacccccgcgaggccaaggtgcagtggaaggtggacaacgccctgcagtccggcaacagccaggaatccgtgaccgagcaggactccaaggacagcacctactccctgtcctccaccctgaccctgtccaaggccgactacgagaagcacaaggtgtacgcctgcgaagtgacccaccagggcctgtctagccccgtgaccaagtctttcaaccggggcgagtgc

SEQ ID NO: 119 - DNA, 2409 bp, Artificial Sequence
  muCD40 VHCH1-muCD40 VHCH1-FcKK_DAPG -28H1 VH
gaagtgcagctggtggaaagcgacggcggactggtgcagcctggcagatctctgaagctgccttgtgccgccagcggcttcaccttcagcgactactacatggcctgggtgcgacaggcccctaccaagggactggaatgggtggccagcatcagctacgacggcagcagcacctactacagagacagcgtgaagggcagattcaccatcagcagagacaacgccaagagcaccctgtacctgcagatggacagcctgagaagcgaggacaccgctacctactactgcggcagacacagcagctacttcgactactggggccagggcgtgatggtcaccgtgtctagcgccaagaccacaccccccagcgtgtaccctctggctcctggatctgccgcccagaccaacagcatggtcacactgggctgcctggtgaagggctacttccccgagcctgtgaccgtgacctggaacagcggctctctgtctagcggcgtgcacaccttccctgccgtgctgcagagcgacctgtacaccctgtcctccagcgtgaccgtgccttcctccacctggccttcccagaccgtgacatgcaacgtggcccaccctgccagctccaccaaggtggacaagaaaatcgtgccccgggactgcggagggggcggttccggcggaggaggatccgaggtgcagctggtggaatctgatgggggcctggtgcagcccggaagaagcctgaaactgccctgtgctgcctctggcttcacattctctgattactatatggcttgggtgcgccaggctccaacaaaaggcctggaatgggtggcatccatctcttacgacggctcctccacttactacagggactctgtgaagggccggttcacaatctcccgggataacgccaagtctacactgtacctgcagatggattccctgcgctccgaggacacagccacatattactgtggcaggcactcctcctactttgattattggggacagggcgtgatggtcacagtgtccagcgctaagaccaccccccctagcgtgtaccctctggcccctggatctgccgcccagaccaacagcatggtgaccctgggctgcctggtgaagggctacttccccgagcctgtgaccgtgacctggaacagcggcagcctgagcagcggcgtgcacacctttccagccgtgctgcagagcgacctgtacaccctgagcagctccgtgaccgtgcctagcagcacctggcccagccagacagtgacctgcaacgtggcccaccctgccagcagcaccaaggtggacaagaaaatcgtgccccgggactgcggctgcaagccctgcatctgcaccgtgcccgaggtgtccagcgtgttcatcttcccacccaagcccaaggacgtgctgaccatcaccctgacccccaaagtgacctgcgtggtggtggccatcagcaaggacgaccccgaggtgcagttctcttggtttgtggacgacgtggaggtgcacacagcccagacaaagccccgggaggaacagatcaacagcaccttcagaagcgtgtccgagctgcccatcatgcaccaggactggctgaacggcaaagaattcaagtgcagagtgaacagcgccgccttcggcgcccccatcgagaaaaccatcagcaagaccaagggcagacccaaggccccccaggtgtacaccatccccccacccaaaaaacagatggccaaggacaaggtgtccctgacctgcatgatcaccaactttttccccgaggacatcaccgtggagtggcagtggaatggccagcccgccgagaactacaagaacacccagcccatcatgaagaccgacggcagctacttcgtgtacagcaagctgaacgtgcagaagtccaactgggaggccggcaacaccttcacctgtagcgtgctgcacgagggcctgcacaaccaccacaccgagaagtccctgagccactcccccggcggcggaggcggttccggaggaggaggatccggaggagggggaagtggcggcggaggatctgaggtgcagctgctggaatccggcggaggcctggtgcagcctggcggatctctgagactgtcctgcgccgcctccggcttcaccttctcctcccacgccatgtcctgggtccgacaggctcctggcaaaggcctggaatgggtgtccgccatctgggcctccggcgagcagtactacgccgactctgtgaagggccggttcaccatctcccgggacaactccaagaacaccctgtacctgcagatgaactccctgcgggccgaggacaccgccgtgtactactgtgccaagggctggctgggcaacttcgactactggggccagggcaccctggtcaccgtgtccagc

SEQ ID NO: 120 - DNA, 2385 bp, Artificial Sequence
  muCD40 VHCH1-muCD40 VHCH1-FcDD_DAPG -28H1 VL
gaagtgcagctggtggaaagcgacggcggactggtgcagcctggcagatctctgaagctgccttgtgccgccagcggcttcaccttcagcgactactacatggcctgggtgcgacaggcccctaccaagggactggaatgggtggccagcatcagctacgacggcagcagcacctactacagagacagcgtgaagggcagattcaccatcagcagagacaacgccaagagcaccctgtacctgcagatggacagcctgagaagcgaggacaccgctacctactactgcggcagacacagcagctacttcgactactggggccagggcgtgatggtcaccgtgtctagcgccaagaccacaccccccagcgtgtaccctctggctcctggatctgccgcccagaccaacagcatggtcacactgggctgcctggtgaagggctacttccccgagcctgtgaccgtgacctggaacagcggctctctgtctagcggcgtgcacaccttccctgccgtgctgcagagcgacctgtacaccctgtcctccagcgtgaccgtgccttcctccacctggccttcccagaccgtgacatgcaacgtggcccaccctgccagctccaccaaggtggacaagaaaatcgtgccccgggactgcggagggggcggttccggcggaggaggatccgaggtgcagctggtggaatctgatgggggcctggtgcagcccggaagaagcctgaaactgccctgtgctgcctctggcttcacattctctgattactatatggcttgggtgcgccaggctccaacaaaaggcctggaatgggtggcatccatctcttacgacggctcctccacttactacagggactctgtgaagggccggttcacaatctcccgggataacgccaagtctacactgtacctgcagatggattccctgcgctccgaggacacagccacatattactgtggcaggcactcctcctactttgattattggggacagggcgtgatggtcacagtgtccagcgctaagaccaccccccctagcgtgtaccctctggcccctggatctgccgcccagaccaacagcatggtgaccctgggctgcctggtgaagggctacttccccgagcctgtgaccgtgacctggaacagcggcagcctgagcagcggcgtgcacacctttccagccgtgctgcagagcgacctgtacaccctgagcagctccgtgaccgtgcctagcagcacctggcccagccagacagtgacctgcaacgtggcccaccctgccagcagcaccaaggtggacaagaaaatcgtgccccgggactgcggctgcaagccctgcatctgcaccgtgcccgaggtgtccagcgtgttcatcttcccacccaagcccaaggacgtgctgaccatcaccctgacccccaaagtgacctgcgtggtggtggccatcagcaaggacgaccccgaggtgcagttctcttggtttgtggacgacgtggaggtgcacacagcccagacaaagccccgggaggaacagatcaacagcaccttcagaagcgtgtccgagctgcccatcatgcaccaggactggctgaacggcaaagaattcaagtgcagagtgaacagcgccgccttcggcgcccccatcgagaaaaccatcagcaagaccaagggcagacccaaggccccccaggtgtacaccatccccccacccaaagaacagatggccaaggacaaggtgtccctgacctgcatgatcaccaactttttccccgaggacatcaccgtggagtggcagtggaatggccagcccgccgagaactacgacaacacccagcccatcatggacaccgacggcagctacttcgtgtacagcgacctgaacgtgcagaagtccaactgggaggccggcaacaccttcacctgtagcgtgctgcacgagggcctgcacaaccaccacaccgagaagtccctgagccacagcccaggcggcggaggcggatctggcggaggaggttccggaggtggcggatctgggggcggtggatctgagatcgtgctgacccagtctcccggcaccctgagcctgagccctggcgagagagccaccctgagctgcagagccagccagagcgtgagccggagctacctggcctggtatcagcagaagcccggccaggcccccagactgctgatcatcggcgccagcacccgggccaccggcatccccgatagattcagcggcagcggctccggcaccgacttcaccctgaccatcagccggctggaacccgaggacttcgccgtgtactactgccagcagggccaggtgatcccccccaccttcggccagggcaccaaggtggaaatcaag

SEQ ID NO: 121 - DNA, 639 bp, Artificial Sequence
  mu CD40 light chain
gacactgtactgacccagtctcctgctttggctgtgtctccaggagagagggttaccatctcctgtagggccagtgacagtgtcagtacacttatgcactggtaccaacagaaaccaggacagcaacccaaactcctcatctatctagcatcacacctagaatctggggtccctgccaggttcagtggcagtgggtctgggacagacttcaccctcaccattgatcctgtggaggctgatgacactgcaacctattactgtcagcagagttggaatgatccgtggacgttcggtggaggcaccaagctggaattgaaacgtgccgatgctgcaccaactgtatcgattttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 122 - DNA, 2700 bp, Artificial Sequence
  muCD40 VHCH1-muCD40 VHCH1-Fc_DAPG-28H1 VLCH1
gaagtgcagctggtggaatccgacggcggactggtgcagcctggcagatctctgaagctgccttgtgccgcctccggcttcaccttctccgactactacatggcctgggtgcgacaggcccctaccaagggactggaatgggtggcctccatctcctacgacggctcctccacctactaccgggactctgtgaagggccggttcaccatctctcgggacaacgccaagtccaccctgtacctgcagatggactccctgcggagcgaggacaccgctacctactactgcggcagacactcctcctacttcgactactggggccagggcgtgatggtcaccgtgtcctctgctaagaccacccccccctccgtgtaccctctggctcctggatctgccgcccagaccaactccatggtcaccctgggctgtctggtggaaggctacttccccgagcctgtgaccgtgacctggaactccggctctctgtcctctggcgtgcacaccttccctgccgtgctgcagtccgacctgtacaccctgagcagctccgtgaccgtgcctagcagcacctggcccagccagacagtgacctgcaacgtggcccaccctgccagcagcaccaaggtggacgagaaaatcgtgccccgggactgcggcggtggaggttccggaggcggcggatccgaggtgcagctggtggaaagtgatgggggcctggtgcagcccggaagaagcctgaaactgccctgcgccgcttctggctttacctttagcgattactatatggcttgggtgcgccaggctccaacaaaaggcctggaatgggtggcatctatcagctacgatggcagcagcacctactatagagacagcgtgaaggggagattcaccatcagcagagataacgctaagagcacactgtacctgcagatggatagcctgagatccgaggataccgccacatattactgtggccggcacagcagctactttgattattggggacagggcgtgatggtcacagtgtctagcgctaagactacccctcctagcgtgtaccccctggcaccaggttccgctgctcagaccaacagcatggtcacactgggatgcctggtggaaggatattttcctgaacccgtgacagtgacatggaatagcggctccctgtctagcggagtgcatacctttccagctgtgctgcagagcgatctgtatacactgagcagctctgtgacagtgccttccagcacctggcccagccagacagtgacctgtaatgtggctcatcccgcctctagcaccaaagtggatgagaaaatcgtgccccgggactgcggctgcaagccctgtatctgtaccgtgcccgaggtgtcctccgtgttcatcttcccacctaagcccaaggacgtgctgacaatcaccctgacccccaaagtgacctgcgtggtggtggccatctccaaggacgatcccgaggtgcagttcagttggttcgtggacgacgtggaagtgcacacagcccagacaaagcccagagaggaacagatcaactccaccttcagaagcgtgtccgagctgcccatcatgcaccaggactggctgaacggcaaagaattcaagtgcagagtgaactccgccgcctttggcgcccctatcgaaaagaccatctccaagaccaagggcagacccaaggccccccaggtgtacacaatccccccacccaaagaacagatggccaaggacaaggtgtccctgacctgcatgatcaccaactttttcccagaggacatcaccgtggaatggcagtggaacggccagcccgccgagaactacaagaacacccagcccatcatggacaccgacggctcctacttcgtgtactccaagctgaacgtgcagaagtccaactgggaggccggcaacaccttcacctgttccgtgctgcacgagggcctgcacaaccaccacaccgagaagtccctgtcccactcccctggaaaaggcggaggcggatctggtggcggaggatctggcggtggtggttccggaggcggtggatctgagatcgtgctgacccagtctcccggcaccctgtcactgtctccaggcgagagagccaccctgtcctgcagagcctctcagtccgtgtcccggtcttacctggcctggtatcagcagaagcccggccaggctccccggctgctgatcatcggagcttctaccagagccaccggcatccccgacagattctccggctctggctctggcaccgacttcaccctgaccatctctcggctggaacccgaggacttcgccgtgtactactgccagcagggccaagtgatcccccccacctttggccagggcaccaaggtggaaatcaagtccagcgctaagaccacccccccctccgtgtatcctctggcccctggatctgccgcccagaccaactccatggtcaccctgggctgcctcgtgaagggctacttccctgagcctgtgaccgtgacctggaactccggctccctgtctagcggcgtgcacacctttccagctgtgctgcagtccgacctgtacaccctgagcagctccgtgaccgtgccttcctccacctggccttcccagaccgtgacatgcaacgtggcccaccctgccagctccacaaaggtggacaagaaaatcgtgccccgggactgc

SEQ ID NO: 123 - DNA, 669 bp, Artificial Sequence
  28H1 VHCL (mu)
gaagtgcagctgctggaatccggcggaggcctggtgcagcctggcggatctctgagactgtcctgcgccgcctccggcttcaccttctcctcccacgccatgtcctgggtccgacaggctcctggcaaaggcctggaatgggtgtccgccatctgggcctccggcgagcagtactacgccgactctgtgaagggccggttcaccatctcccgggacaactccaagaacaccctgtacctgcagatgaactccctgcgggccgaggacaccgccgtgtactactgtgccaagggctggctgggcaacttcgactactggggacagggcaccctggtcaccgtgtccagcgcttctgatgccgcccctaccgtatcgattttcccaccctccagcgagcagctgacaagcggcggagctagcgtcgtgtgcttcctgaacaacttctaccccaaggacatcaacgtgaagtggaagatcgacggcagcgagcggcagaacggcgtgctgaatagctggaccgaccaggacagcaaggactccacctacagcatgagcagcaccctgaccctgaccaaggacgagtacgagcggcacaacagctacacatgcgaggccacccacaagaccagcaccagccccatcgtgaagtccttcaaccggaacgagtgc

SEQ ID NO: 124 - DNA, 639 bp, Artificial Sequence
  mu CD40 light chain; 'RK'
gacactgtactgacccagtctcctgctttggctgtgtctccaggagagagggttaccatctcctgtagggccagtgacagtgtcagtacacttatgcactggtaccaacagaaaccaggacagcaacccaaactcctcatctatctagcatcacacctagaatctggggtccctgccaggttcagtggcagtgggtctgggacagacttcaccctcaccattgatcctgtggaggctgatgacactgcaacctattactgtcagcagagttggaatgatccgtggacgttcggtggaggcaccaagctggaattgaaacgtgccgatgctgcaccaactgtatcgattttcccaccatccagtcggaagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 125 - DNA, 2406 bp, Artificial Sequence
  muCD40 VHCH1-muCD40 VHCH1-FcKK_DAPG-DP47 VH
gaagtgcagctggtggaaagcgacggcggactggtgcagcctggcagatctctgaagctgccttgtgccgccagcggcttcaccttcagcgactactacatggcctgggtgcgacaggcccctaccaagggactggaatgggtggccagcatcagctacgacggcagcagcacctactacagagacagcgtgaagggcagattcaccatcagcagagacaacgccaagagcaccctgtacctgcagatggacagcctgagaagcgaggacaccgctacctactactgcggcagacacagcagctacttcgactactggggccagggcgtgatggtcaccgtgtctagcgccaagaccacaccccccagcgtgtaccctctggctcctggatctgccgcccagaccaacagcatggtcacactgggctgcctggtgaagggctacttccccgagcctgtgaccgtgacctggaacagcggctctctgtctagcggcgtgcacaccttccctgccgtgctgcagagcgacctgtacaccctgtcctccagcgtgaccgtgccttcctccacctggccttcccagaccgtgacatgcaacgtggcccaccctgccagctccaccaaggtggacaagaaaatcgtgccccgggactgcggagggggcggttccggcggaggaggatccgaggtgcagctggtggaatctgatgggggcctggtgcagcccggaagaagcctgaaactgccctgtgctgcctctggcttcacattctctgattactatatggcttgggtgcgccaggctccaacaaaaggcctggaatgggtggcatccatctcttacgacggctcctccacttactacagggactctgtgaagggccggttcacaatctcccgggataacgccaagtctacactgtacctgcagatggattccctgcgctccgaggacacagccacatattactgtggcaggcactcctcctactttgattattggggacagggcgtgatggtcacagtgtccagcgctaagaccaccccccctagcgtgtaccctctggcccctggatctgccgcccagaccaacagcatggtgaccctgggctgcctggtgaagggctacttccccgagcctgtgaccgtgacctggaacagcggcagcctgagcagcggcgtgcacacctttccagccgtgctgcagagcgacctgtacaccctgagcagctccgtgaccgtgcctagcagcacctggcccagccagacagtgacctgcaacgtggcccaccctgccagcagcaccaaggtggacaagaaaatcgtgccccgggactgcggctgcaagccctgcatctgcaccgtgcccgaggtgtccagcgtgttcatcttcccacccaagcccaaggacgtgctgaccatcaccctgacccccaaagtgacctgcgtggtggtggccatcagcaaggacgaccccgaggtgcagttctcttggtttgtggacgacgtggaggtgcacacagcccagacaaagccccgggaggaacagatcaacagcaccttcagaagcgtgtccgagctgcccatcatgcaccaggactggctgaacggcaaagaattcaagtgcagagtgaacagcgccgccttcggcgcccccatcgagaaaaccatcagcaagaccaagggcagacccaaggccccccaggtgtacaccatccccccacccaaaaaacagatggccaaggacaaggtgtccctgacctgcatgatcaccaactttttccccgaggacatcaccgtggagtggcagtggaatggccagcccgccgagaactacaagaacacccagcccatcatgaagaccgacggcagctacttcgtgtacagcaagctgaacgtgcagaagtccaactgggaggccggcaacaccttcacctgtagcgtgctgcacgagggcctgcacaaccaccacaccgagaagtccctgagccactcccccggcggcggaggcggttccggaggaggaggatccggaggagggggaagtggcggcggaggatctgaggtgcaattgttggagtctgggggaggcttggtacagcctggggggtccctgagactctcctgtgcagccagcggattcacctttagcagttatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcagatgaacagcctgagagccgaggacacggccgtatattactgtgcgaaaggcagcggatttgactactggggccaaggaaccctggtcaccgtctcgagc

SEQ ID NO: 126 - DNA, 2385 bp, Artificial Sequence
  muCD40 VHCH1-mu CD40 VHCH1-FcDD_DAPG-DP47 VL
gaagtgcagctggtggaaagcgacggcggactggtgcagcctggcagatctctgaagctgccttgtgccgccagcggcttcaccttcagcgactactacatggcctgggtgcgacaggcccctaccaagggactggaatgggtggccagcatcagctacgacggcagcagcacctactacagagacagcgtgaagggcagattcaccatcagcagagacaacgccaagagcaccctgtacctgcagatggacagcctgagaagcgaggacaccgctacctactactgcggcagacacagcagctacttcgactactggggccagggcgtgatggtcaccgtgtctagcgccaagaccacaccccccagcgtgtaccctctggctcctggatctgccgcccagaccaacagcatggtcacactgggctgcctggtgaagggctacttccccgagcctgtgaccgtgacctggaacagcggctctctgtctagcggcgtgcacaccttccctgccgtgctgcagagcgacctgtacaccctgtcctccagcgtgaccgtgccttcctccacctggccttcccagaccgtgacatgcaacgtggcccaccctgccagctccaccaaggtggacaagaaaatcgtgccccgggactgcggagggggcggttccggcggaggaggatccgaggtgcagctggtggaatctgatgggggcctggtgcagcccggaagaagcctgaaactgccctgtgctgcctctggcttcacattctctgattactatatggcttgggtgcgccaggctccaacaaaaggcctggaatgggtggcatccatctcttacgacggctcctccacttactacagggactctgtgaagggccggttcacaatctcccgggataacgccaagtctacactgtacctgcagatggattccctgcgctccgaggacacagccacatattactgtggcaggcactcctcctactttgattattggggacagggcgtgatggtcacagtgtccagcgctaagaccaccccccctagcgtgtaccctctggcccctggatctgccgcccagaccaacagcatggtgaccctgggctgcctggtgaagggctacttccccgagcctgtgaccgtgacctggaacagcggcagcctgagcagcggcgtgcacacctttccagccgtgctgcagagcgacctgtacaccctgagcagctccgtgaccgtgcctagcagcacctggcccagccagacagtgacctgcaacgtggcccaccctgccagcagcaccaaggtggacaagaaaatcgtgccccgggactgcggctgcaagccctgcatctgcaccgtgcccgaggtgtccagcgtgttcatcttcccacccaagcccaaggacgtgctgaccatcaccctgacccccaaagtgacctgcgtggtggtggccatcagcaaggacgaccccgaggtgcagttctcttggtttgtggacgacgtggaggtgcacacagcccagacaaagccccgggaggaacagatcaacagcaccttcagaagcgtgtccgagctgcccatcatgcaccaggactggctgaacggcaaagaattcaagtgcagagtgaacagcgccgccttcggcgcccccatcgagaaaaccatcagcaagaccaagggcagacccaaggccccccaggtgtacaccatccccccacccaaagaacagatggccaaggacaaggtgtccctgacctgcatgatcaccaactttttccccgaggacatcaccgtggagtggcagtggaatggccagcccgccgagaactacgacaacacccagcccatcatggacaccgacggcagctacttcgtgtacagcgacctgaacgtgcagaagtccaactgggaggccggcaacaccttcacctgtagcgtgctgcacgagggcctgcacaaccaccacaccgagaagtccctgagccacagcccaggcggcggaggcggatctggcggaggaggttccggaggcggcggaagcggagggggaggctctgaaattgtgctgacccagagccccggcaccctgtcactgtctccaggcgaaagagccaccctgagctgcagagccagccagagcgtgtccagctcttacctggcctggtatcagcagaagcccggacaggcccccagactgctgatctacggcgcctcttctagagccaccggcatccccgatagattcagcggcagcggctccggcaccgacttcaccctgacaatcagcagactggaacccgaggactttgccgtgtattactgccagcagtacggcagcagccccctgacctttggccagggcaccaaggtggaaatcaaa

SEQ ID NO: 127 - DNA, 2700 bp, Artificial Sequence
  muCD40 VHCH1-muCD40 VHCH1-Fc_DAPG-28H1 VLCH1
gaagtgcagctggtggaatccgacggcggactggtgcagcctggcagatctctgaagctgccttgtgccgcctccggcttcaccttctccgactactacatggcctgggtgcgacaggcccctaccaagggactggaatgggtggcctccatctcctacgacggctcctccacctactaccgggactctgtgaagggccggttcaccatctctcgggacaacgccaagtccaccctgtacctgcagatggactccctgcggagcgaggacaccgctacctactactgcggcagacactcctcctacttcgactactggggccagggcgtgatggtcaccgtgtcctctgctaagaccacccccccctccgtgtaccctctggctcctggatctgccgcccagaccaactccatggtcaccctgggctgtctggtggaaggctacttccccgagcctgtgaccgtgacctggaactccggctctctgtcctctggcgtgcacaccttccctgccgtgctgcagtccgacctgtacaccctgagcagctccgtgaccgtgcctagcagcacctggcccagccagacagtgacctgcaacgtggcccaccctgccagcagcaccaaggtggacgagaaaatcgtgccccgggactgcggcggtggaggttccggaggcggcggatccgaggtgcagctggtggaaagtgatgggggcctggtgcagcccggaagaagcctgaaactgccctgcgccgcttctggctttacctttagcgattactatatggcttgggtgcgccaggctccaacaaaaggcctggaatgggtggcatctatcagctacgatggcagcagcacctactatagagacagcgtgaaggggagattcaccatcagcagagataacgctaagagcacactgtacctgcagatggatagcctgagatccgaggataccgccacatattactgtggccggcacagcagctactttgattattggggacagggcgtgatggtcacagtgtctagcgctaagactacccctcctagcgtgtaccccctggcaccaggttccgctgctcagaccaacagcatggtcacactgggatgcctggtggaaggatattttcctgaacccgtgacagtgacatggaatagcggctccctgtctagcggagtgcatacctttccagctgtgctgcagagcgatctgtatacactgagcagctctgtgacagtgccttccagcacctggcccagccagacagtgacctgtaatgtggctcatcccgcctctagcaccaaagtggatgagaaaatcgtgccccgggactgcggctgcaagccctgtatctgtaccgtgcccgaggtgtcctccgtgttcatcttcccacctaagcccaaggacgtgctgacaatcaccctgacccccaaagtgacctgcgtggtggtggccatctccaaggacgatcccgaggtgcagttcagttggttcgtggacgacgtggaagtgcacacagcccagacaaagcccagagaggaacagatcaactccaccttcagaagcgtgtccgagctgcccatcatgcaccaggactggctgaacggcaaagaattcaagtgcagagtgaactccgccgcctttggcgcccctatcgaaaagaccatctccaagaccaagggcagacccaaggccccccaggtgtacacaatccccccacccaaagaacagatggccaaggacaaggtgtccctgacctgcatgatcaccaactttttcccagaggacatcaccgtggaatggcagtggaacggccagcccgccgagaactacaagaacacccagcccatcatggacaccgacggctcctacttcgtgtactccaagctgaacgtgcagaagtccaactgggaggccggcaacaccttcacctgttccgtgctgcacgagggcctgcacaaccaccacaccgagaagtccctgtcccactcccctggaaaaggcggaggcggatctggtggcggaggatctggcggtggtggttccggaggcggaggatccgaaatcgtgttaacgcagtctccaggcaccctgtctttgtctccaggggaaagagccaccctctcttgcagggccagtcagagtgttagcagcagctacttagcctggtaccagcagaaacctggccaggctcccaggctcctcatctatggagcatccagcagggccactggcatcccagacaggttcagtggcagtggatccgggacagacttcactctcaccatcagcagactggagcctgaagattttgcagtgtattactgtcagcagtatggtagctcaccgctgacgttcggccaggggaccaaagtggaaatcaaaagcagcgctaagaccacccccccctccgtgtatcctctggcccctggatctgccgcccagaccaactccatggtcaccctgggctgcctcgtgaagggctacttccctgagcctgtgaccgtgacctggaactccggctccctgtctagcggcgtgcacacctttccagctgtgctgcagtccgacctgtacaccctgagcagctccgtgaccgtgccttcctccacctggccttcccagaccgtgacatgcaacgtggcccaccctgccagctccacaaaggtggacaagaaaatcgtgccccgggactgc

SEQ ID NO: 128 - DNA, 666 bp, Artificial Sequence
  DP47 VHCL (mu)
gaggtgcaattgttggagtctgggggaggcttggtacagcctggggggtccctgagactctcctgtgcagcctccggattcacctttagcagttatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcagatgaacagcctgagagccgaggacacggccgtatattactgtgcgaaaggcagcggatttgactactggggccaaggaaccctggtcaccgtctcgagcgcttctgatgccgcccctaccgtatcgattttcccaccctccagcgagcagctgacaagcggcggagctagcgtcgtgtgcttcctgaacaacttctaccccaaggacatcaacgtgaagtggaagatcgacggcagcgagcggcagaacggcgtgctgaatagctggaccgaccaggacagcaaggactccacctacagcatgagcagcaccctgaccctgaccaaggacgagtacgagcggcacaacagctacacatgcgaggccacccacaagaccagcaccagccccatcgtgaagtccttcaaccggaacgagtgc

SEQ ID NO: 129 - protein, 114 aa, Artificial Sequence
  CD40 (S2C6) VH
EVQLQQSGPDLVKPGASVKISCKASGYSFTGYYIHWVKQSHGKSLEWIGRVIPNNGGTSYNQKFKGKAILTVDKSSSTAYMELRSLTSEDSAVYYCAREGIYWWGHGTTLTVSS

SEQ ID NO: 130 - protein, 112 aa, Artificial Sequence
  CD40 (S2C6) VL
DVVVTQTPLSLPVSLGAQASISCRSSQSLVHSNGNTFLHWYLQKPGQSPKLLIYTVSNRFSGVPDRFSGSGSGTDFTLKISRVEAEDLGVYFCSQTTHVPWTFGGGTKLEIQ

SEQ ID NO: 131 - protein, 808 aa, Artificial Sequence
  hVH3_CD40 VHCH1-VHCH1-Fc knob_PGLALA -4B9 VH
QVQLVQSGAEVKKPGASVKVSCKASGYSFTGYYIHWVRQAPGQGLEWIGRVIPNAGGTSYNQKFKGRVTSTVDTSISTAYMELSRLRSDDTVVYYCAREGIYWWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDGGGGSGGGGSQVQLVQSGAEVKKPGASVKVSCKASGYSFTGYYIHWVRQAPGQGLEWIGRVIPNAGGTSYNQKFKGRVTSTVDTSISTAYMELSRLRSDDTVVYYCAREGIYWWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEVQLLESGGGLVQPGGSLRLSCAASGFTFSSYAMSWVRQAPGKGLEWVSAIIGSGASTYYADSVKGRFTISRDNSKNTLYLQMNSLRAEDTAVYYCAKGWFGGFNYWGQGTLVTVSS

SEQ ID NO: 132 - protein, 799 aa, Artificial Sequence
  hVH3_CD40 VHCH1- VHCH1-Fc hole_PGLALA-4B9 VL
QVQLVQSGAEVKKPGASVKVSCKASGYSFTGYYIHWVRQAPGQGLEWIGRVIPNAGGTSYNQKFKGRVTSTVDTSISTAYMELSRLRSDDTVVYYCAREGIYWWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDGGGGSGGGGSQVQLVQSGAEVKKPGASVKVSCKASGYSFTGYYIHWVRQAPGQGLEWIGRVIPNAGGTSYNQKFKGRVTSTVDTSISTAYMELSRLRSDDTVVYYCAREGIYWWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSGGGGSGGGGSEIVLTQSPGTLSLSPGERATLSCRASQSVTSSYLAWYQQKPGQAPRLLINVGSRRATGIPDRFSGSGSGTDFTLTISRLEPEDFAVYYCQQGIMLPPTFGQGTKVEIK

SEQ ID NO: 133 - protein, 219 aa, Artificial Sequence
  hVK2_CD40 light chain
DVVMTQSPLSLPVTLGQPASISCRSSQSLVHSNGNTFLHWYQQRPGQSPRLLIYTVSNRFSGVPDRFSGSGSGTDFTLKISRVEAEDVGVYYCSQTTHVPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 134 - protein, 580 aa, Artificial Sequence
  hVH3_CD40 VHCH1- Fc knob_PGLALA -4B9 VH
QVQLVQSGAEVKKPGASVKVSCKASGYSFTGYYIHWVRQAPGQGLEWIGRVIPNAGGTSYNQKFKGRVTSTVDTSISTAYMELSRLRSDDTVVYYCAREGIYWWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEVQLLESGGGLVQPGGSLRLSCAASGFTFSSYAMSWVRQAPGKGLEWVSAIIGSGASTYYADSVKGRFTISRDNSKNTLYLQMNSLRAEDTAVYYCAKGWFGGFNYWGQGTLVTVSS

SEQ ID NO: 135 - protein, 571 aa, Artificial Sequence
  hVH3_CD40 VHCH1- Fc hole_PGLALA -4B9 VL
QVQLVQSGAEVKKPGASVKVSCKASGYSFTGYYIHWVRQAPGQGLEWIGRVIPNAGGTSYNQKFKGRVTSTVDTSISTAYMELSRLRSDDTVVYYCAREGIYWWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSGGGGSGGGGSEIVLTQSPGTLSLSPGERATLSCRASQSVTSSYLAWYQQKPGQAPRLLINVGSRRATGIPDRFSGSGSGTDFTLTISRLEPEDFAVYYCQQGIMLPPTFGQGTKVEIK

SEQ ID NO: 136 - protein, 676 aa, Artificial Sequence
  hVH3_CD40-Fc knob _PGLALA_4B9_VLCH1 'EE'
QVQLVQSGAEVKKPGASVKVSCKASGYSFTGYYIHWVRQAPGQGLEWIGRVIPNAGGTSYNQKFKGRVTSTVDTSISTAYMELSRLRSDDTVVYYCAREGIYWWGQGTTVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEIVLTQSPGTLSLSPGERATLSCRASQSVTSSYLAWYQQKPGQAPRLLINVGSRRATGIPDRFSGSGSGTDFTLTISRLEPEDFAVYYCQQGIMLPPTFGQGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 137 - protein, 219 aa, Artificial Sequence
  hVK2_CD40 LC ,RK'
DVVMTQSPLSLPVTLGQPASISCRSSQSLVHSNGNTFLHWYQQRPGQSPRLLIYTVSNRFSGVPDRFSGSGSGTDFTLKISRVEAEDVGVYYCSQTTHVPWTFGQGTKVEIKRTVAAPSVFIFPPSDRKLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 138 - protein, 224 aa, Artificial Sequence
  4B9 VHCL
EVQLLESGGGLVQPGGSLRLSCAASGFTFSSYAMSWVRQAPGKGLEWVSAIIGSGASTYYADSVKGRFTISRDNSKNTLYLQMNSLRAEDTAVYYCAKGWFGGFNYWGQGTLVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 139 - protein, 676 aa, Artificial Sequence
  hVH3_CD40-Fc hole_PGLALA 'EE'
QVQLVQSGAEVKKPGASVKVSCKASGYSFTGYYIHWVRQAPGQGLEWIGRVIPNAGGTSYNQKFKGRVTSTVDTSISTAYMELSRLRSDDTVVYYCAREGIYWWGQGTTVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEIVLTQSPGTLSLSPGERATLSCRASQSVTSSYLAWYQQKPGQAPRLLINVGSRRATGIPDRFSGSGSGTDFTLTISRLEPEDFAVYYCQQGIMLPPTFGQGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 140 - protein, 443 aa, Artificial Sequence
  hVH3_CD40-Fc hole_PGLALA 'EE'
QVQLVQSGAEVKKPGASVKVSCKASGYSFTGYYIHWVRQAPGQGLEWIGRVIPNAGGTSYNQKFKGRVTSTVDTSISTAYMELSRLRSDDTVVYYCAREGIYWWGQGTTVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 141 - protein, 439 aa, Artificial Sequence
  4B9-Fc knob_PGLALA
EIVLTQSPGTLSLSPGERATLSCRASQSVTSSYLAWYQQKPGQAPRLLINVGSRRATGIPDRFSGSGSGTDFTLTISRLEPEDFAVYYCQQGIMLPPTFGQGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 142 - protein, 748 aa, Artificial Sequence
  hu FAP ectodomain+poly-lys-tag+his6-tag
RPSRVHNSEENTMRALTLKDILNGTFSYKTFFPNWISGQEYLHQSADNNIVLYNIETGQSYTILSNRTMKSVNASNYGLSPDRQFVYLESDYSKLWRYSYTATYYIYDLSNGEFVRGNELPRPIQYLCWSPVGSKLAYVYQNNIYLKQRPGDPPFQITFNGRENKIFNGIPDWVYEEEMLATKYALWWSPNGKFLAYAEFNDTDIPVIAYSYYGDEQYPRTINIPYPKAGAKNPVVRIFIIDTTYPAYVGPQEVPVPAMIASSDYYFSWLTWVTDERVCLQWLKRVQNVSVLSICDFREDWQTWDCPKTQEHIEESRTGWAGGFFVSTPVFSYDAISYYKIFSDKDGYKHIHYIKDTVENAIQITSGKWEAINIFRVTQDSLFYSSNEFEEYPGRRNIYRISIGSYPPSKKCVTCHLRKERCQYYTASFSDYAKYYALVCYGPGIPISTLHDGRTDQEIKILEENKELENALKNIQLPKEEIKKLEVDEITLWYKMILPPQFDRSKKYPLLIQVYGGPCSQSVRSVFAVNWISYLASKEGMVIALVDGRGTAFQGDKLLYAVYRKLGVYEVEDQITAVRKFIEMGFIDEKRIAIWGWSYGGYVSSLALASGTGLFKCGIAVAPVSSWEYYASVYTERFMGLPTKDDNLEHYKNSTVMARAEYFRNVDYLLIHGTADDNVHFQNSAQIAKALVNAQVDFQAMWYSDQNHGLSGLSTNHLYTHMTHFLKQCFSLSDGKKKKKKGHHHHHH

SEQ ID NO: 143 - protein, 761 aa, murine
MKTWLKTVFGVTTLAALALVVICIVLRPSRVYKPEGNTKRALTLKDILNGTFSYKTYFPNWISEQEYLHQSEDDNIVFYNIETRESYIILSNSTMKSVNATDYGLSPDRQFVYLESDYSKLWRYSYTATYYIYDLQNGEFVRGYELPRPIQYLCWSPVGSKLAYVYQNNIYLKQRPGDPPFQITYTGRENRIFNGIPDWVYEEEMLATKYALWWSPDGKFLAYVEFNDSDIPIIAYSYYGDGQYPRTINIPYPKAGAKNPVVRVFIVDTTYPHHVGPMEVPVPEMIASSDYYFSWLTWVSSERVCLQWLKRVQNVSVLSICDFREDWHAWECPKNQEHVEESRTGWAGGFFVSTPAFSQDATSYYKIFSDKDGYKHIHYIKDTVENAIQITSGKWEAIYIFRVTQDSLFYSSNEFEGYPGRRNIYRISIGNSPPSKKCVTCHLRKERCQYYTASFSYKAKYYALVCYGPGLPISTLHDGRTDQEIQVLEENKELENSLRNIQLPKVEIKKLKDGGLTFWYKMILPPQFDRSKKYPLLIQVYGGPCSQSVKSVFAVNWITYLASKEGIVIALVDGRGTAFQGDKFLHAVYRKLGVYEVEDQLTAVRKFIEMGFIDEERIAIWGWSYGGYVSSLALASGTGLFKCGIAVAPVSSWEYYASIYSERFMGLPTKDDNLEHYKNSTVMARAEYFRNVDYLLIHGTADDNVHFQNSAQIAKALVNAQVDFQAMWYSDQNHGISSGRSQNHLYTHMTHFLKQCFSLSD

SEQ ID NO: 144 - protein, 749 aa, Artificial Sequence
  Murine FAP ectodomain+poly-lys-tag+his6-tag
RPSRVYKPEGNTKRALTLKDILNGTFSYKTYFPNWISEQEYLHQSEDDNIVFYNIETRESYIILSNSTMKSVNATDYGLSPDRQFVYLESDYSKLWRYSYTATYYIYDLQNGEFVRGYELPRPIQYLCWSPVGSKLAYVYQNNIYLKQRPGDPPFQITYTGRENRIFNGIPDWVYEEEMLATKYALWWSPDGKFLAYVEFNDSDIPIIAYSYYGDGQYPRTINIPYPKAGAKNPVVRVFIVDTTYPHHVGPMEVPVPEMIASSDYYFSWLTWVSSERVCLQWLKRVQNVSVLSICDFREDWHAWECPKNQEHVEESRTGWAGGFFVSTPAFSQDATSYYKIFSDKDGYKHIHYIKDTVENAIQITSGKWEAIYIFRVTQDSLFYSSNEFEGYPGRRNIYRISIGNSPPSKKCVTCHLRKERCQYYTASFSYKAKYYALVCYGPGLPISTLHDGRTDQEIQVLEENKELENSLRNIQLPKVEIKKLKDGGLTFWYKMILPPQFDRSKKYPLLIQVYGGPCSQSVKSVFAVNWITYLASKEGIVIALVDGRGTAFQGDKFLHAVYRKLGVYEVEDQLTAVRKFIEMGFIDEERIAIWGWSYGGYVSSLALASGTGLFKCGIAVAPVSSWEYYASIYSERFMGLPTKDDNLEHYKNSTVMARAEYFRNVDYLLIHGTADDNVHFQNSAQIAKALVNAQVDFQAMWYSDQNHGILSGRSQNHLYTHMTHFLKQCFSLSDGKKKKKKGHHHHHH

SEQ ID NO: 145 - protein, 748 aa, Artificial Sequence
  Cynomolgus FAP ectodomain+poly-lys-tag+his6-tag
RPPRVHNSEENTMRALTLKDILNGTFSYKTFFPNWISGQEYLHQSADNNIVLYNIETGQSYTILSNRTMKSVNASNYGLSPDRQFVYLESDYSKLWRYSYTATYYIYDLSNGEFVRGNELPRPIQYLCWSPVGSKLAYVYQNNIYLKQRPGDPPFQITFNGRENKIFNGIPDWVYEEEMLATKYALWWSPNGKFLAYAEFNDTDIPVIAYSYYGDEQYPRTINIPYPKAGAKNPFVRIFIIDTTYPAYVGPQEVPVPAMIASSDYYFSWLTWVTDERVCLQWLKRVQNVSVLSICDFREDWQTWDCPKTQEHIEESRTGWAGGFFVSTPVFSYDAISYYKIFSDKDGYKHIHYIKDTVENAIQITSGKWEAINIFRVTQDSLFYSSNEFEDYPGRRNIYRISIGSYPPSKKCVTCHLRKERCQYYTASFSDYAKYYALVCYGPGIPISTLHDGRTDQEIKILEENKELENALKNIQLPKEEIKKLEVDEITLWYKMILPPQFDRSKKYPLLIQVYGGPCSQSVRSVFAVNWISYLASKEGMVIALVDGRGTAFQGDKLLYAVYRKLGVYEVEDQITAVRKFIEMGFIDEKRIAIWGWSYGGYVSSLALASGTGLFKCGIAVAPVSSWEYYASVYTERFMGLPTKDDNLEHYKNSTVMARAEYFRNVDYLLIHGTADDNVHFQNSAQIAKALVNAQVDFQAMWYSDQNHGLSGLSTNHLYTHMTHFLKQCFSLSDGKKKKKKGHHHHHH

SEQ ID NO: 146 - protein, 289 aa, Mus musculus
MVSLPRLCALWGCLLTAVHLGQCVTCSDKQYLHDGQCCDLCQPGSRLTSHCTALEKTQCHPCDSGEFSAQWNREIRCHQHRHCEPNQGLRVKKEGTAESDTVCTCKEGQHCTSKDCEACAQHTPCIPGFGVMEMATETTDTVCHPCPVGFFSNQSSLFEKCYPWTSCEDKNLEVLQKGTSQTNVICGLKSRMRALLVIPVVMGILITIFGVFLYIKKVVKKPKDNEILPPAARRQDPQEMEDYPGHNTAAPVQETLHGCQPVTQEDGKESRISVQERQVTDSIALRPLV

SEQ ID NO: 147 - protein, 5 aa, Artificial Sequence
  Peptide linker G4S
GGGGS

SEQ ID NO: 148 - protein, 10 aa, Artificial Sequence
  Peptide linker (G4S)2
GGGGSGGGGS

SEQ ID NO: 149 - protein, 10 aa, Artificial Sequence
  Peptide linker (SG4)2
SGGGGSGGGG

SEQ ID NO: 150 - protein, 14 aa, Artificial Sequence
  Peptide linker G4(SG4)2
GGGGSGGGGSGGGG

SEQ ID NO: 151 - protein, 10 aa, Artificial Sequence
  Peptide linker
GSPGSSSSGS

SEQ ID NO: 152 - protein, 15 aa, Artificial Sequence
  Peptide linker (G4S)3
GGGGSGGGGSGGGGS

SEQ ID NO: 153 - protein, 20 aa, Artificial Sequence
  Peptide linker (G4S)4
GGGGSGGGGSGGGGSGGGGS

SEQ ID NO: 154 - protein, 8 aa, Artificial Sequence
  Peptide linker
GSGSGSGS

SEQ ID NO: 155 - protein, 8 aa, Artificial Sequence
  Peptide linker
GSGSGNGS

SEQ ID NO: 156 - protein, 8 aa, Artificial Sequence
  Peptide linker
GGSGSGSG

SEQ ID NO: 157 - protein, 6 aa, Artificial Sequence
  Peptide linker
GGSGSG

SEQ ID NO: 158 - protein, 4 aa, Artificial Sequence
  Peptide linker
GGSG

SEQ ID NO: 159 - protein, 8 aa, Artificial Sequence
  Peptide linker
GGSGNGSG

SEQ ID NO: 160 - protein, 8 aa, Artificial Sequence
  Peptide linker
GGNGSGSG

SEQ ID NO: 161 - protein, 6 aa, Artificial Sequence
  Peptide linker
GGNGSG

SEQ ID NO: 162 - protein, 223 aa, Artificial Sequence; identical to SEQ ID NO: 87
  28H1 light chain cross VHCL

SEQ ID NO: 163 - protein, 439 aa, Artificial Sequence
  28H1 (VLCH1)_FC knob_ PGLALA
EIVLTQSPGTLSLSPGERATLSCRASQSVSRSYLAWYQQKPGQAPRLLIIGASTRATGIPDRFSGSGSGTDFTLTISRLEPEDFAVYYCQQGQVIPPTFGQGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 164 - protein, 444 aa, Artificial Sequence
  CD40 (VHCH1 charged)_Fc hole_PGLALA
EVQLVESGGGLVQPGGSLRLSCAASGYSFTGYYIHWVRQAPGKGLEWVARVIPNAGGTSYNQKFKGRFTLSVDNSKNTAYLQMNSLRAEDTAVYYCAREGIYWWGQGTLVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPGK

SEQ ID NO: 165 - protein, 219 aa, Artificial Sequence; identical to SEQ ID NO: 86
  CD40 light chain (charged)

SEQ ID NO: 166 - protein, 667 aa, Artificial Sequence
  CD40 (VHCH1 charged)_28H1 (VLCH1)_FC knob_ PGLALA
EVQLVESGGGLVQPGGSLRLSCAASGYSFTGYYIHWVRQAPGKGLEWVARVIPNAGGTSYNQKFKGRFTLSVDNSKNTAYLQMNSLRAEDTAVYYCAREGIYWWGQGTLVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDGGGGSGGGGSEIVLTQSPGTLSLSPGERATLSCRASQSVSRSYLAWYQQKPGQAPRLLIIGASTRATGIPDRFSGSGSGTDFTLTISRLEPEDFAVYYCQQGQVIPPTFGQGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 167 - protein, 676 aa, Artificial Sequence
  CD40 (VHCH1 charged)_Fc knob_PGLALA_28H1 (VLCH1)
EVQLVESGGGLVQPGGSLRLSCAASGYSFTGYYIHWVRQAPGKGLEWVARVIPNAGGTSYNQKFKGRFTLSVDNSKNTAYLQMNSLRAEDTAVYYCAREGIYWWGQGTLVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEIVLTQSPGTLSLSPGERATLSCRASQSVSRSYLAWYQQKPGQAPRLLIIGASTRATGIPDRFSGSGSGTDFTLTISRLEPEDFAVYYCQQGQVIPPTFGQGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 168 - protein, 443 aa, Artificial Sequence
  CD40 (VHCH1 charged)_Fc hole_PGLALA without C-terminal lysine
EVQLVESGGGLVQPGGSLRLSCAASGYSFTGYYIHWVRQAPGKGLEWVARVIPNAGGTSYNQKFKGRFTLSVDNSKNTAYLQMNSLRAEDTAVYYCAREGIYWWGQGTLVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 169 - protein, 904 aa, Artificial Sequence
  CD40 (VHCH1 charged_CD40 (VHCH1 charged)-Fc knob_PGLALA_28H1 (VLCH1)
EVQLVESGGGLVQPGGSLRLSCAASGYSFTGYYIHWVRQAPGKGLEWVARVIPNAGGTSYNQKFKGRFTLSVDNSKNTAYLQMNSLRAEDTAVYYCAREGIYWWGQGTLVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDGGGGSGGGGSEVQLVESGGGLVQPGGSLRLSCAASGYSFTGYYIHWVRQAPGKGLEWVARVIPNAGGTSYNQKFKGRFTLSVDNSKNTAYLQMNSLRAEDTAVYYCAREGIYWWGQGTLVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEIVLTQSPGTLSLSPGERATLSCRASQSVSRSYLAWYQQKPGQAPRLLIIGASTRATGIPDRFSGSGSGTDFTLTISRLEPEDFAVYYCQQGQVIPPTFGQGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 170 - protein, 671 aa, Artificial Sequence
  CD40 (VHCH1 charged_CD40 (VHCH1 charged)-Fc hole_PGLALA
EVQLVESGGGLVQPGGSLRLSCAASGYSFTGYYIHWVRQAPGKGLEWVARVIPNAGGTSYNQKFKGRFTLSVDNSKNTAYLQMNSLRAEDTAVYYCAREGIYWWGQGTLVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDGGGGSGGGGSEVQLVESGGGLVQPGGSLRLSCAASGYSFTGYYIHWVRQAPGKGLEWVARVIPNAGGTSYNQKFKGRFTLSVDNSKNTAYLQMNSLRAEDTAVYYCAREGIYWWGQGTLVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 171 - protein, 114 aa, Artificial Sequence
  VH1a (CD40)
QVQLVQSGAEVKKPGASVKVSCKASGYSFTGYYIHWVRQAPGQSLEWMGRVIPNAGGTSYNQKFKGRVTLTVDKSISTAYMELSRLRSDDTAVYYCAREGIYWWGQGTTVTVSS

SEQ ID NO: 172 - protein, 114 aa, Artificial Sequence
  VH1b (CD40)
QVQLVQSGAEVKKPGASVKVSCKASGYSFTGYYIHWVRQAPGKSLEWMGRVIPNAGGTSYNQKFKGRVTLTVDKSISTAYMELSRLRSDDTAVYYCAREGIYWWGQGTTVTVSS

SEQ ID NO: 173 - protein, 114 aa, Artificial Sequence
  VH1c (CD40)
QVQLVQSGAEVKKPGASVKVSCKASGYSFTGYYIHWVRQAPGQSLEWMGRVIPNAGGTSYNQKFKGRVTLTVDKSISTAYMELSRLRSDDTAVYYCAREGIYWWGHGTTVTVSS

SEQ ID NO: 174 - protein, 114 aa, Artificial Sequence
  VH1d (CD40)
QVQLVQSGAEVKKPGASVKVSCKASGYSFTGYYIHWVRQAPGQSLEWMGRVIPNAGGTSYNQKFKGRVTLSVDKSISTAYMELSRLRSDDTAVYYCAREGIYWWGQGTTVTVSS

SEQ ID NO: 175 - protein, 112 aa, Artificial Sequence
  VL1a (CD40)
DIVMTQTPLSLSVTPGQPASISCRSSQSLVHSNGNTFLHWYLQKPGQSPQLLIYTVSNRFSGVPDRFSGSGSGTDFTLKISRVEAEDVGVYFCSQTTHVPWTFGGGTKVEIK

SEQ ID NO: 176 - protein, 112 aa, Artificial Sequence
  VL1b (CD40)
DIVVTQTPLSLSVTPGQPASISCRSSQSLVHSNGNTFLHWYLQKPGQSPQLLIYTVSNRFSGVPDRFSGSGSGTDFTLKISRVEAEDVGVYFCSQTTHVPWTFGGGTKVEIK

SEQ ID NO: 177 - protein, 112 aa, Artificial Sequence
  VL1c (CD40)
DVVVTQTPLSLSVTPGQPASISCRSSQSLVHSNGNTFLHWYLQKPGQSPQLLIYTVSNRFSGVPDRFSGSGSGTDFTLKISRVEAEDVGVYFCSQTTHVPWTFGGGTKVEIK

SEQ ID NO: 178 - protein, 112 aa, Artificial Sequence
  VL1d (CD40)
DVVVTQTPLSLSVTPGQPASISCRSSQSLVHSNGNTFLHWYLQKPGQSPQLLIYTVSNRFSGVPDRFSGSGSGTDFTLKISRVEAEDVGVYFCSQTTHVPWTFGGGTKLEIK

SEQ ID NO: 179 - protein, 114 aa, Artificial Sequence
  VH2a (CD40)
EVQLLESGGGLVQPGGSLRLSCAASGYSFTGYYIHWVRQAPGKGLEWVGRVIPNAGGTSYNQKFKGRFTISVDNSKNTAYLQMNSLRAEDTAVYYCAREGIYWWGQGTTVTVSS

SEQ ID NO: 180 - protein, 114 aa, Artificial Sequence
  VH2b (CD40)
EVQLLESGGGLVQPGGSLRLSCAASGYSFTGYYIHWVRQAPGKSLEWVGRVIPNAGGTSYNQKFKGRFTISVDNSKNTAYLQMNSLRAEDTAVYYCAREGIYWWGQGTTVTVSS

SEQ ID NO: 181 - protein, 114 aa, Artificial Sequence
  VH2c (CD40)
EVQLLESGGGLVQPGGSLRLSCAASGYSFTGYYIHWVRQAPGKGLEWVGRVIPNAGGTSYNQKFKGRFTISVDNSKNTAYLQMNSLRAEDTAVYYCAREGIYWWGHGTTVTVSS

SEQ ID NO: 182 - protein, 114 aa, Artificial Sequence
  VH2d (CD40)
EVQLLESGGGLVQPGGSLRLSCAASGYSFTGYYIHWVRQAPGKGLEWVGRVIPNAGGTSYGDSVKGRFTISVDNSKNTAYLQMNSLRAEDTAVYYCAREGIYWWGQGTTVTVSS

SEQ ID NO: 183 - protein, 114 aa, Artificial Sequence
  VH2ab (CD40)
EVQLLESGGGLVQPGGSLRLSCAASGYSFTGYYMHWVRQAPGKGLEWVGRVIPNAGGTSYNQKFKGRFTISVDNSKNTAYLQMNSLRAEDTAVYYCAREGIYWWGQGTTVTVSS

SEQ ID NO: 184 - protein, 114 aa, Artificial Sequence
  VH2ac (CD40)
EVQLLESGGGLVQPGGSLRLSCAASGYSFTGYYIHWVRQAPGKGLEWVGRVIPNAGGTSYNQKVKGRFTISVDNSKNTAYLQMNSLRAEDTAVYYCAREGIYWWGQGTTVTVSS

SEQ ID NO: 185 - protein, 112 aa, Artificial Sequence
  VL2a (CD40)
DIQMTQSPSSLSASVGDRVTITCRSSQSLVHSNGNTFLHWYQQKPGKAPKLLIYTVSNRFSGVPSRFSGSGSGTDFTLTISSLQPEDFATYFCSQTTHVPWTFGGGTKVEIK

SEQ ID NO: 186 - protein, 112 aa, Artificial Sequence
  VL2b (CD40)
DIQMTQSPSSLSASVGDRVTITCRSSQSLVHSNGNTFLHWYQQKPGQSPKLLIYTVSNRFSGVPSRFSGSGSGTDFTLTISSLQPEDFATYFCSQTTHVPWTFGGGTKVEIK

SEQ ID NO: 187 - protein, 112 aa, Artificial Sequence
  VL2ab (CD40)
DIQMTQSPSSLSASVGDRVTITCRASQSLVHSNGNTFLHWYQQKPGKAPKLLIYTVSNRFSGVPSRFSGSGSGTDFTLTISSLQPEDFATYFCSQTTHVPWTFGGGTKVEIK

SEQ ID NO: 188 - protein, 112 aa, Artificial Sequence
  VL2ac (CD40)
DIQMTQSPSSLSASVGDRVTITCRSSQSIVHSNGNTFLHWYQQKPGKAPKLLIYTVSNRFSGVPSRFSGSGSGTDFTLTISSLQPEDFATYFCSQTTHVPWTFGGGTKVEIK

SEQ ID NO: 189 - protein, 443 aa, Artificial Sequence
  P1AE0400 Heavy chain
EVQLLESGGGLVQPGGSLRLSCAASGYSFTGYYIHWVRQAPGKGLEWVGRVIPNAGGTSYNQKFKGRFTISVDNSKNTAYLQMNSLRAEDTAVYYCAREGIYWWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 190 - protein, 219 aa, Artificial Sequence
  P1AE0400 light chain
DIQMTQSPSSLSASVGDRVTITCRSSQSLVHSNGNTFLHWYQQKPGKAPKLLIYTVSNRFSGVPSRFSGSGSGTDFTLTISSLQPEDFATYFCSQTTHVPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 191 - protein, 443 aa, Artificial Sequence
  P1AE0401 heavy chain
EVQLLESGGGLVQPGGSLRLSCAASGYSFTGYYIHWVRQAPGKSLEWVGRVIPNAGGTSYNQKFKGRFTISVDNSKNTAYLQMNSLRAEDTAVYYCAREGIYWWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 192 - protein, 219 aa, Artificial Sequence; identical to SEQ ID NO: 190
  P1AE0401 light chain

SEQ ID NO: 193 - protein, 443 aa, Artificial Sequence
  P1AE0402 heavy chain
EVQLLESGGGLVQPGGSLRLSCAASGYSFTGYYIHWVRQAPGKGLEWVGRVIPNAGGTSYNQKFKGRFTISVDNSKNTAYLQMNSLRAEDTAVYYCAREGIYWWGHGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 194 - protein, 219 aa, Artificial Sequence; identical to SEQ ID NO: 190
  P1AE0402 light chain

SEQ ID NO: 195 - protein, 443 aa, Artificial Sequence
  P1AE0403 heavy chain
EVQLLESGGGLVQPGGSLRLSCAASGYSFTGYYIHWVRQAPGKGLEWVGRVIPNAGGTSYGDSVKGRFTISVDNSKNTAYLQMNSLRAEDTAVYYCAREGIYWWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 196 - protein, 219 aa, Artificial Sequence; identical to SEQ ID NO: 190
  P1AE0403 light chain

SEQ ID NO: 197 - protein, 443 aa, Artificial Sequence; identical to SEQ ID NO: 189
  P1AE0404 heavy chain

SEQ ID NO: 198 - protein, 219 aa, Artificial Sequence
  P1AE0404 light chain
DIQMTQSPSSLSASVGDRVTITCRSSQSLVHSNGNTFLHWYQQKPGQSPKLLIYTVSNRFSGVPSRFSGSGSGTDFTLTISSLQPEDFATYFCSQTTHVPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 199 - protein, 443 aa, Artificial Sequence; identical to SEQ ID NO: 191
  P1AE0405 heavy chain

SEQ ID NO: 200 - protein, 219 aa, Artificial Sequence; identical to SEQ ID NO: 198
  P1AE0405 light chain

SEQ ID NO: 201 - protein, 443 aa, Artificial Sequence; identical to SEQ ID NO: 193
  P1AE0406 heavy chain

SEQ ID NO: 202 - protein, 219 aa, Artificial Sequence; identical to SEQ ID NO: 198
  P1AE0406 light chain

SEQ ID NO: 203 - protein, 443 aa, Artificial Sequence; identical to SEQ ID NO: 195
  P1AE0407 heavy chain

SEQ ID NO: 204 - protein, 219 aa, Artificial Sequence; identical to SEQ ID NO: 198
  P1AE0407 light chain

SEQ ID NO: 205 - protein, 443 aa, Artificial Sequence
  P1AE0817 heavy chain
QVQLVQSGAEVKKPGASVKVSCKASGYSFTGYYIHWVRQAPGQSLEWMGRVIPNAGGTSYNQKFKGRVTLTVDKSISTAYMELSRLRSDDTAVYYCAREGIYWWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 206 - protein, 219 aa, Artificial Sequence
  P1AE0817 light chain
DIVMTQTPLSLSVTPGQPASISCRSSQSLVHSNGNTFLHWYLQKPGQSPQLLIYTVSNRFSGVPDRFSGSGSGTDFTLKISRVEAEDVGVYFCSQTTHVPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 207 - protein, 443 aa, Artificial Sequence
  P1AE0818 heavy chain
QVQLVQSGAEVKKPGASVKVSCKASGYSFTGYYIHWVRQAPGQSLEWMGRVIPNAGGTSYNQKFKGRVTLTVDKSISTAYMELSRLRSDDTAVYYCAREGIYWWGHGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 208 - protein, 219 aa, Artificial Sequence
  P1AE0818 light chain
DVVVTQTPLSLSVTPGQPASISCRSSQSLVHSNGNTFLHWYLQKPGQSPQLLIYTVSNRFSGVPDRFSGSGSGTDFTLKISRVEAEDVGVYFCSQTTHVPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 209 - protein, 443 aa, Artificial Sequence
  P1AE0819 heavy chain
QVQLVQSGAEVKKPGASVKVSCKASGYSFTGYYIHWVRQAPGQSLEWMGRVIPNAGGTSYNQKFKGRVTLSVDKSISTAYMELSRLRSDDTAVYYCAREGIYWWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 210 - protein, 219 aa, Artificial Sequence
  P1AE0819 light chain
DVVVTQTPLSLSVTPGQPASISCRSSQSLVHSNGNTFLHWYLQKPGQSPQLLIYTVSNRFSGVPDRFSGSGSGTDFTLKISRVEAEDVGVYFCSQTTHVPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 211 - protein, 443 aa, Artificial Sequence; identical to SEQ ID NO: 205
  P1AE0993 heavy chain

SEQ ID NO: 212 - protein, 219 aa, Artificial Sequence; identical to SEQ ID NO: 208
  P1AE0993 light chain

SEQ ID NO: 213 - protein, 443 aa, Artificial Sequence; identical to SEQ ID NO: 205
  P1AE0996 heavy chain

SEQ ID NO: 214 - protein, 219 aa, Artificial Sequence; identical to SEQ ID NO: 210
  P1AE0996 light chain

SEQ ID NO: 215 - protein, 443 aa, Artificial Sequence; identical to SEQ ID NO: 207
  P1AE0997 heavy chain

SEQ ID NO: 216 - protein, 219 aa, Artificial Sequence; identical to SEQ ID NO: 206
  P1AE0997 light chain

SEQ ID NO: 217 - protein, 443 aa, Artificial Sequence; identical to SEQ ID NO: 207
  P1AE0998 heavy chain

SEQ ID NO: 218 - protein, 219 aa, Artificial Sequence; identical to SEQ ID NO: 210
  P1AE0998 light chain

SEQ ID NO: 219 - protein, 443 aa, Artificial Sequence; identical to SEQ ID NO: 209
  P1AE0999 heavy chain

SEQ ID NO: 220 - protein, 219 aa, Artificial Sequence; identical to SEQ ID NO: 206
  P1AE0999 light chain

SEQ ID NO: 221 - protein, 443 aa, Artificial Sequence; identical to SEQ ID NO: 209
  P1AE1000 heavy chain

SEQ ID NO: 222 - protein, 219 aa, Artificial Sequence; identical to SEQ ID NO: 208
  P1AE1000 light chain

SEQ ID NO: 223 - protein, 443 aa, Artificial Sequence; identical to SEQ ID NO: 205
  P1AE1001 heavy chain

SEQ ID NO: 224 - protein, 219 aa, Artificial Sequence
  P1AE1001 light chain
DIVVTQTPLSLSVTPGQPASISCRSSQSLVHSNGNTFLHWYLQKPGQSPQLLIYTVSNRFSGVPDRFSGSGSGTDFTLKISRVEAEDVGVYFCSQTTHVPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 225 - protein, 443 aa, Artificial Sequence
  P1AE1002 heavy chain
QVQLVQSGAEVKKPGASVKVSCKASGYSFTGYYIHWVRQAPGKSLEWMGRVIPNAGGTSYNQKFKGRVTLTVDKSISTAYMELSRLRSDDTAVYYCAREGIYWWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 226 - protein, 219 aa, Artificial Sequence; identical to SEQ ID NO: 206
  P1AE1002 light chain

SEQ ID NO: 227 - protein, 443 aa, Artificial Sequence; identical to SEQ ID NO: 225
  P1AE1003 heavy chain

SEQ ID NO: 228 - protein, 219 aa, Artificial Sequence; identical to SEQ ID NO: 224
  P1AE1003 light chain

SEQ ID NO: 229 - protein, 443 aa, Artificial Sequence; identical to SEQ ID NO: 225
  P1AE1004 heavy chain

SEQ ID NO: 230 - protein, 219 aa, Artificial Sequence; identical to SEQ ID NO: 208
  P1AE1004 light chain

SEQ ID NO: 231 - protein, 443 aa, Artificial Sequence; identical to SEQ ID NO: 225
  P1AE1005 heavy chain

SEQ ID NO: 232 - protein, 219 aa, Artificial Sequence; identical to SEQ ID NO: 210
  P1AE1005 light chain

SEQ ID NO: 233 - protein, 443 aa, Artificial Sequence; identical to SEQ ID NO: 207
  P1AE1006 heavy chain

SEQ ID NO: 234 - protein, 219 aa, Artificial Sequence; identical to SEQ ID NO: 224
  P1AE1006 light chain

SEQ ID NO: 235 - protein, 443 aa, Artificial Sequence; identical to SEQ ID NO: 209
  P1AE1007 heavy chain

SEQ ID NO: 236 - protein, 219 aa, Artificial Sequence; identical to SEQ ID NO: 224
  P1AE1007 light chain

SEQ ID NO: 237 - protein, 443 aa, Artificial Sequence
  P1AE1125 heavy chain
EVQLLESGGGLVQPGGSLRLSCAASGYSFTGYYMHWVRQAPGKGLEWVGRVIPNAGGTSYNQKFKGRFTISVDNSKNTAYLQMNSLRAEDTAVYYCAREGIYWWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 238 - protein, 219 aa, Artificial Sequence
  P1AE1125 light chain
DIQMTQSPSSLSASVGDRVTITCRASQSLVHSNGNTFLHWYQQKPGKAPKLLIYTVSNRFSGVPSRFSGSGSGTDFTLTISSLQPEDFATYFCSQTTHVPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 239 - protein, 443 aa, Artificial Sequence; identical to SEQ ID NO: 237
  P1AE1126 heavy chain

SEQ ID NO: 240 - protein, 219 aa, Artificial Sequence
  P1AE1126 light chain
DIQMTQSPSSLSASVGDRVTITCRSSQSIVHSNGNTFLHWYQQKPGKAPKLLIYTVSNRFSGVPSRFSGSGSGTDFTLTISSLQPEDFATYFCSQTTHVPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 241 - protein, 443 aa, Artificial Sequence
  P1AE1135 heavy chain
EVQLLESGGGLVQPGGSLRLSCAASGYSFTGYYIHWVRQAPGKGLEWVGRVIPNAGGTSYNQKVKGRFTISVDNSKNTAYLQMNSLRAEDTAVYYCAREGIYWWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 242 - protein, 219 aa, Artificial Sequence; identical to SEQ ID NO: 240
  P1AE1135 light chain

SEQ ID NO: 243 - protein, 219 aa, Artificial Sequence
  VL2a (CD40) light chain (charged)
DIQMTQSPSSLSASVGDRVTITCRSSQSLVHSNGNTFLHWYQQKPGKAPKLLIYTVSNRFSGVPSRFSGSGSGTDFTLTISSLQPEDFATYFCSQTTHVPWTFGGGTKVEIKRTVAAPSVFIFPPSDRKLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 244 - protein, 904 aa, Artificial Sequence
  VH2a (CD40) (VHCH1 charged_VH2a (CD40) (VHCH1 charged)-Fc knob_PGLALA_28H1 (VLCH1)
EVQLLESGGGLVQPGGSLRLSCAASGYSFTGYYIHWVRQAPGKGLEWVGRVIPNAGGTSYNQKFKGRFTISVDNSKNTAYLQMNSLRAEDTAVYYCAREGIYWWGQGTTVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDGGGGSGGGGSEVQLLESGGGLVQPGGSLRLSCAASGYSFTGYYIHWVRQAPGKGLEWVGRVIPNAGGTSYNQKFKGRFTISVDNSKNTAYLQMNSLRAEDTAVYYCAREGIYWWGQGTTVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEIVLTQSPGTLSLSPGERATLSCRASQSVSRSYLAWYQQKPGQAPRLLIIGASTRATGIPDRFSGSGSGTDFTLTISRLEPEDFAVYYCQQGQVIPPTFGQGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 245 - protein, 671 aa, Artificial Sequence
  VH2a (CD40) (VHCH1 charged_VH2a (CD40) (VHCH1 charged)-Fc hole_PGLALA
EVQLLESGGGLVQPGGSLRLSCAASGYSFTGYYIHWVRQAPGKGLEWVGRVIPNAGGTSYNQKFKGRFTISVDNSKNTAYLQMNSLRAEDTAVYYCAREGIYWWGQGTTVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDGGGGSGGGGSEVQLLESGGGLVQPGGSLRLSCAASGYSFTGYYIHWVRQAPGKGLEWVGRVIPNAGGTSYNQKFKGRFTISVDNSKNTAYLQMNSLRAEDTAVYYCAREGIYWWGQGTTVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 246 - protein, 904 aa, Artificial Sequence
  VH2d (CD40) (VHCH1 charged_VH2d (CD40) (VHCH1 charged)-Fc knob_PGLALA_28H1 (VLCH1)
EVQLLESGGGLVQPGGSLRLSCAASGYSFTGYYIHWVRQAPGKGLEWVGRVIPNAGGTSYGDSVKGRFTISVDNSKNTAYLQMNSLRAEDTAVYYCAREGIYWWGQGTTVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDGGGGSGGGGSEVQLLESGGGLVQPGGSLRLSCAASGYSFTGYYIHWVRQAPGKGLEWVGRVIPNAGGTSYGDSVKGRFTISVDNSKNTAYLQMNSLRAEDTAVYYCAREGIYWWGQGTTVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEIVLTQSPGTLSLSPGERATLSCRASQSVSRSYLAWYQQKPGQAPRLLIIGASTRATGIPDRFSGSGSGTDFTLTISRLEPEDFAVYYCQQGQVIPPTFGQGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 247 - protein, 671 aa, Artificial Sequence
  VH2d (CD40) (VHCH1 charged_VH2d (CD40) (VHCH1 charged)-Fc hole_PGLALA
EVQLLESGGGLVQPGGSLRLSCAASGYSFTGYYIHWVRQAPGKGLEWVGRVIPNAGGTSYGDSVKGRFTISVDNSKNTAYLQMNSLRAEDTAVYYCAREGIYWWGQGTTVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDGGGGSGGGGSEVQLLESGGGLVQPGGSLRLSCAASGYSFTGYYIHWVRQAPGKGLEWVGRVIPNAGGTSYGDSVKGRFTISVDNSKNTAYLQMNSLRAEDTAVYYCAREGIYWWGQGTTVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 248 - protein, 219 aa, Artificial Sequence
  VL1a (CD40) light chain (charged)
DIVMTQTPLSLSVTPGQPASISCRSSQSLVHSNGNTFLHWYLQKPGQSPQLLIYTVSNRFSGVPDRFSGSGSGTDFTLKISRVEAEDVGVYFCSQTTHVPWTFGGGTKVEIKRTVAAPSVFIFPPSDRKLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 249 - protein, 904 aa, Artificial Sequence
  VH1a (CD40) (VHCH1) _VH1a (CD40) (VHCH1) Fc knob_PGLALA_28H1 (VLCH1) (charged)
QVQLVQSGAEVKKPGASVKVSCKASGYSFTGYYIHWVRQAPGQSLEWMGRVIPNAGGTSYNQKFKGRVTLTVDKSISTAYMELSRLRSDDTAVYYCAREGIYWWGQGTTVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDGGGGSGGGGSQVQLVQSGAEVKKPGASVKVSCKASGYSFTGYYIHWVRQAPGQSLEWMGRVIPNAGGTSYNQKFKGRVTLTVDKSISTAYMELSRLRSDDTAVYYCAREGIYWWGQGTTVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEIVLTQSPGTLSLSPGERATLSCRASQSVSRSYLAWYQQKPGQAPRLLIIGASTRATGIPDRFSGSGSGTDFTLTISRLEPEDFAVYYCQQGQVIPPTFGQGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 250 - protein, 671 aa, Artificial Sequence
  VH1a (CD40) (VHCH1) _VH1a (CD40) (VHCH1)-Fc hole_PGLALA (charged)
QVQLVQSGAEVKKPGASVKVSCKASGYSFTGYYIHWVRQAPGQSLEWMGRVIPNAGGTSYNQKFKGRVTLTVDKSISTAYMELSRLRSDDTAVYYCAREGIYWWGQGTTVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDGGGGSGGGGSQVQLVQSGAEVKKPGASVKVSCKASGYSFTGYYIHWVRQAPGQSLEWMGRVIPNAGGTSYNQKFKGRVTLTVDKSISTAYMELSRLRSDDTAVYYCAREGIYWWGQGTTVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 251 - protein, 676 aa, Artificial Sequence
  VH1a (CD40) (VHCH1) Fc knob_PGLALA_28H1 (VLCH1) (charged)
QVQLVQSGAEVKKPGASVKVSCKASGYSFTGYYIHWVRQAPGQSLEWMGRVIPNAGGTSYNQKFKGRVTLTVDKSISTAYMELSRLRSDDTAVYYCAREGIYWWGQGTTVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEIVLTQSPGTLSLSPGERATLSCRASQSVSRSYLAWYQQKPGQAPRLLIIGASTRATGIPDRFSGSGSGTDFTLTISRLEPEDFAVYYCQQGQVIPPTFGQGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 252 - protein, 443 aa, Artificial Sequence
  VH1a (CD40) (VHCH1) Fc hole_PGLALA (charged)
QVQLVQSGAEVKKPGASVKVSCKASGYSFTGYYIHWVRQAPGQSLEWMGRVIPNAGGTSYNQKFKGRVTLTVDKSISTAYMELSRLRSDDTAVYYCAREGIYWWGQGTTVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 253 - protein, 676 aa, Artificial Sequence
  VH1a (CD40) (VHCH1) Fc knob_PGLALA_4B9 (VLCH1) (charged)
QVQLVQSGAEVKKPGASVKVSCKASGYSFTGYYIHWVRQAPGQSLEWMGRVIPNAGGTSYNQKFKGRVTLTVDKSISTAYMELSRLRSDDTAVYYCAREGIYWWGQGTTVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEIVLTQSPGTLSLSPGERATLSCRASQSVTSSYLAWYQQKPGQAPRLLINVGSRRATGIPDRFSGSGSGTDFTLTISRLEPEDFAVYYCQQGIMLPPTFGQGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 254 - protein, 213 aa, Artificial Sequence
  4B9 light chain cross VLCH1
EIVLTQSPGTLSLSPGERATLSCRASQSVTSSYLAWYQQKPGQAPRLLINVGSRRATGIPDRFSGSGSGTDFTLTISRLEPEDFAVYYCQQGIMLPPTFGQGTKVEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 255 - protein, 687 aa, Artificial Sequence
  VH1a (CD40) (VHCH1) Fc knob_PGLALA_4B9 (VHCL) (charged)
QVQLVQSGAEVKKPGASVKVSCKASGYSFTGYYIHWVRQAPGQSLEWMGRVIPNAGGTSYNQKFKGRVTLTVDKSISTAYMELSRLRSDDTAVYYCAREGIYWWGQGTTVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDEKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEVQLLESGGGLVQPGGSLRLSCAASGFTFSSYAMSWVRQAPGKGLEWVSAIIGSGASTYYADSVKGRFTISRDNSKNTLYLQMNSLRAEDTAVYYCAKGWFGGFNYWGQGTLVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 256 - protein, 219 aa, Artificial Sequence; identical to SEQ ID NO: 206
  VL1a (CD40) light chain

SEQ ID NO: 257 - protein, 687 aa, Artificial Sequence
  VH1a (CD40) (VHCH1) Fc knob_PGLALA_4B9 (VHCL)
QVQLVQSGAEVKKPGASVKVSCKASGYSFTGYYIHWVRQAPGQSLEWMGRVIPNAGGTSYNQKFKGRVTLTVDKSISTAYMELSRLRSDDTAVYYCAREGIYWWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSEVQLLESGGGLVQPGGSLRLSCAASGFTFSSYAMSWVRQAPGKGLEWVSAIIGSGASTYYADSVKGRFTISRDNSKNTLYLQMNSLRAEDTAVYYCAKGWFGGFNYWGQGTLVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 258 - protein, 443 aa, Artificial Sequence
  VH1a (CD40) (VHCH1) Fc hole_PGLALA
QVQLVQSGAEVKKPGASVKVSCKASGYSFTGYYIHWVRQAPGQSLEWMGRVIPNAGGTSYNQKFKGRVTLTVDKSISTAYMELSRLRSDDTAVYYCAREGIYWWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 259 - protein, 443 aa, Artificial Sequence
  P1AE0816 heavy chain (control)
QVQLVQSGAEVKKPGASVKVSCKASGYSFTGYYIHWVRQAPGQSLEWMGRVIPNNGGTSYNQKFQGRVTISVDKSISTAYMELSSLRSEDTAVYYCAREGIYWWGHGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 260 - protein, 219 aa, Artificial Sequence
  P1AE0816 light chain (control)
DVVVTQSPLSLPVTPGEPASISCRSSQSLVHSNGNTFLHWYLQKPGQSPQLLIYTVSNRFSGVPDRFSGSGSGTDFTLKISRVEAEDVGVYFCSQTTHVPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 261 - protein, 5 aa, Artificial Sequence
  hu CD40  CDR-H1 (VH2ab)
GYYMH

SEQ ID NO: 262 - protein, 17 aa, Artificial Sequence
  hu CD40  CDR-H2 (VH2ab)
RVIPNAGGTSYNQKFKG

SEQ ID NO: 263 - protein, 17 aa, Artificial Sequence
  hu CD40  CDR-H2 (VH2ac)
RVIPNAGGTSYNQKVKG

SEQ ID NO: 264 - protein, 16 aa, Artificial Sequence
  hu CD40  CDR-L1 (VL2ab)
RASQSLVHSNGNTFLH

SEQ ID NO: 265 - protein, 16 aa, Artificial Sequence
  hu CD40  CDR-L1 (VL2ac)
RSSQSIVHSNGNTFLH

SEQ ID NO: 266 - protein, 201 aa, Artificial Sequence
  Hu_CD40_ECD_His_Avi
EPPTACREKQYLINSQCCSLCQPGQKLVSDCTEFTETECLPCGESEFLDTWNRETHCHQHKYCDPNLGLRVQQKGTSETDTICTCEEGWHCTSEACESCVLHRSCSPGFGVKQIATGVSDTICEPCPVGFFSNVSSAFEKCHPWTSCETKDLVVQQAGTNKTDVVCGPQDRLRGGGGSHHHHHHGSGLNDIFEAQKIEWHE

SEQ ID NO: 267 - protein, 201 aa, Artificial Sequence
  cyno_CD40_ECD_His_Avi
EPPTACREKQYLINSQCCSLCQPGQKLVSDCTEFTETECLPCSESEFLDTWNRETRCHQHKYCDPNLGLRVQQKGTSETDTICTCEEGLHCTSESCESCVPHRSCLPGFGVKQIATGVSDTICEPCPVGFFSNVSSAFEKCRPWTSCETKDLVVQQAGTNKTDVVCGPQDRQRGGGGSHHHHHHGSGLNDIFEAQKIEWHE

SEQ ID NO: 268 - protein, 451 aa, Artificial Sequence
  Selicrelumab IgG2 heavy chain
QVQLVQSGAEVKKPGASVKVSCKASGYTFTGYYMHWVRQAPGQGLEWMGWINPDSGGTNYAQKFQGRVTMTRDTSISTAYMELNRLRSDDTAVYYCARDQPLGYCTNGVCSYFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTRFVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 269 - protein, 214 aa, Artificial Sequence
  Selicrelumab IgG2 light chain
DIQMTQSPSSVSASVGDRVTITCRASQGIYSWLAWYQQKPGKAPNLLIYTASTLQSGVPSRFSGSGSGTDFTLTISSLQPEDFATYYCQQANIFPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

The invention claimed is:

1. A bispecific antigen binding molecule, comprising
(a) (i) at least one antigen binding domain capable of specific binding to CD40, comprising a heavy chain variable region (VH-CD40) comprising the amino acid sequence of SEQ ID NO:171, SEQ ID NO:172, SEQ ID NO:173, SEQ ID NO: 174, SEQ ID NO:179, SEQ ID NO:180, SEQ ID NO: 181, SEQ ID NO:182, SEQ ID NO: 183 or SEQ ID NO: 184,
and a light chain variable region (VL-CD40) comprising the amino acid sequence of SEQ ID NO: 175, SEQ ID NO:176, SEQ ID NO:177, SEQ ID NO: 178, SEQ ID NO:185, SEQ ID NO:186, SEQ ID NO: 187 or SEQ ID NO:188; or
(ii) a heavy chain variable region (VH-CD40) comprising the amino acid sequence of SEQ ID NO: 179, SEQ ID NO:180, SEQ ID NO: 181, SEQ ID NO: 182, SEQ ID NO:183 or SEQ ID NO:184, and
a light chain variable region (VL-CD40) comprising the amino acid sequence of SEQ ID NO: 185, SEQ ID NO:186, SEQ ID NO: 187 or, SEQ ID NO: 188, and
(b) at least one antigen binding domain capable of specific binding to Fibroblast Activation Protein (FAP) comprising a heavy chain variable region (VH-FAP) comprising the amino acid sequence of SEQ ID NO:9 and a light chain variable region (VL-FAP) comprising the amino acid sequence of SEQ ID NO: 10, or a heavy chain variable region (VH-FAP) comprising the amino acid sequence of SEQ ID NO:17 and a light chain variable region (VL-FAP) comprising the amino acid sequence of SEQ ID NO:18; and
(c) an Fc region composed of a first and a second subunit capable of stable association.

2. The bispecific antigen binding molecule of claim 1, wherein the antigen binding domain capable of specific binding to CD40 comprises:
(i) a heavy chain variable region (VH-CD40) comprising the amino acid sequence of SEQ ID NO:171, SEQ ID NO:172, SEQ ID NO:173 or SEQ ID NO:174, and
(ii) a light chain variable region (VL-CD40) comprising the amino acid sequence of SEQ ID NO: 175, SEQ ID NO: 176, SEQ ID NO: 177, or SEQ ID NO: 178.

3. The bispecific antigen binding molecule of claim 1, wherein the antigen binding domain capable of specific binding to CD40 comprises:
(i) a heavy chain variable region (VH-CD40) comprising the amino acid sequence of SEQ ID NO: 179, SEQ ID NO:180, SEQ ID NO: 181, SEQ ID NO: 182, SEQ ID NO: 183 or SEQ ID NO:184, and
(ii) a light chain variable region (VL-CD40) comprising the amino acid sequence of SEQ ID NO: 185, SEQ ID NO:186, SEQ ID NO: 187 or, SEQ ID NO: 188.

4. The bispecific antigen binding molecule of claim 2, wherein the antigen binding domain capable of specific binding to CD40 comprises:
(a) a VH comprising the amino acid sequence of SEQ ID NO:171 and a VL comprising the amino acid sequence of SEQ ID NO:175, or
(b) a VH comprising the amino acid sequence of SEQ ID NO:173 and a VL comprising the amino acid sequence of SEQ ID NO:177, or
(c) a VH comprising the amino acid sequence of SEQ ID NO: 174 and a VL comprising the amino acid sequence of SEQ ID NO:178, or
(d) a VH comprising the amino acid sequence of SEQ ID NO:171 and a VL comprising the amino acid sequence of SEQ ID NO:177, or
(e) a VH comprising the amino acid sequence of SEQ ID NO:171 and a VL comprising the amino acid sequence of SEQ ID NO: 178, or
(f) a VH comprising the amino acid sequence of SEQ ID NO:173 and a VL comprising the amino acid sequence of SEQ ID NO:175, or
(g) a VH comprising the amino acid sequence of SEQ ID NO:173 and a VL comprising the amino acid sequence of SEQ ID NO:178, or
(h) a VH comprising the amino acid sequence of SEQ ID NO:174 and a VL comprising the amino acid sequence of SEQ ID NO:175, or
(i) a VH comprising the amino acid sequence of SEQ ID NO:174 and a VL comprising the amino acid sequence of SEQ ID NO: 177, or
(j) a VH comprising the amino acid sequence of SEQ ID NO:171 and a VL comprising the amino acid sequence of SEQ ID NO:176, or
(k) a VH comprising the amino acid sequence of SEQ ID NO:172 and a VL comprising the amino acid sequence of SEQ ID NO: 175, or
(l) a VH comprising the amino acid sequence of SEQ ID NO:172 and a VL comprising the amino acid sequence of SEQ ID NO:176, or
(m) a VH comprising the amino acid sequence of SEQ ID NO:172 and a VL comprising the amino acid sequence of SEQ ID NO:177, or
(n) a VH comprising the amino acid sequence of SEQ ID NO: 172 and a VL comprising the amino acid sequence of SEQ ID NO: 178, or
(o) a VH comprising the amino acid sequence of SEQ ID NO: 173 and a VL comprising the amino acid sequence of SEQ ID NO:176, or
(p) a VH comprising the amino acid sequence of SEQ ID NO:174 and a VL comprising the amino acid sequence of SEQ ID NO:176.

5. The bispecific antigen binding molecule of claim 4, wherein the antigen binding domain capable of specific binding to CD40 comprises a VH comprising the amino acid sequence of SEQ ID NO:171 and a VL comprising the amino acid sequence of SEQ ID NO: 175.

6. The bispecific antigen binding molecule of claim 3, wherein the antigen binding domain capable of specific binding to CD40 comprises:
(a) a VH comprising the amino acid sequence of SEQ ID NO:179 and a VL comprising the amino acid sequence of SEQ ID NO:185, or
(b) a VH comprising the amino acid sequence of SEQ ID NO: 180 and a VL comprising the amino acid sequence of SEQ ID NO: 185, or
(c) a VH comprising the amino acid sequence of SEQ ID NO: 181 and a VL comprising the amino acid sequence of SEQ ID NO:185, or
(d) a VH comprising the amino acid sequence of SEQ ID NO:182 and a VL comprising the amino acid sequence of SEQ ID NO:185, or
(e) a VH comprising the amino acid sequence of SEQ ID NO:179 and a VL comprising the amino acid sequence of SEQ ID NO:186, or
(f) a VH comprising the amino acid sequence of SEQ ID NO:180 and a VL comprising the amino acid sequence of SEQ ID NO:186, or
(g) a VH comprising the amino acid sequence of SEQ ID NO:181 and a VL comprising the amino acid sequence of SEQ ID NO:186, or
(h) a VH comprising the amino acid sequence of SEQ ID NO:182 and a VL comprising the amino acid sequence of SEQ ID NO: 186, or
(i) a VH comprising the amino acid sequence of SEQ ID NO: 183 and a VL comprising the amino acid sequence of SEQ ID NO:187, or
(j) a VH comprising the amino acid sequence of SEQ ID NO:183 and a VL comprising the amino acid sequence of SEQ ID NO:188, or
(k) a VH comprising the amino acid sequence of SEQ ID NO:184 and a VL comprising the amino acid sequence of SEQ ID NO:187, or
(l) a VH comprising the amino acid sequence of SEQ ID NO:184 and a VL comprising the amino acid sequence of SEQ ID NO:188.

7. The bispecific antigen binding molecule of claim 6, wherein the antigen binding domain capable of specific binding to CD40 comprises a VH comprising the amino acid sequence of SEQ ID NO:179 and a VL comprising the amino acid sequence of SEQ ID NO:185 or wherein the antigen binding domain capable of specific binding to CD40 comprises a VH comprising the amino acid sequence of SEQ ID NO:182 and a VL comprising the amino acid sequence of SEQ ID NO:185.

8. The bispecific antigen binding molecule of claim 1, comprising:
(i) at least one antigen binding domain capable of specific binding to CD40, comprising a heavy chain variable region (VH-CD40) comprising the amino acid sequence of SEQ ID NO:171 and a light chain variable region (VL-CD40) comprising the amino acid sequence of SEQ ID NO: 175, and
(ii) at least one antigen binding domain capable of specific binding to FAP, comprising a heavy chain variable region (VH-FAP) comprising the amino acid sequence of SEQ ID NO:17 and a light chain variable region (VL-FAP) comprising the amino acid sequence of SEQ ID NO: 18.

9. The bispecific antigen binding molecule of claim 1, wherein the Fc region is an IgG1 Fc region or an IgG4 Fc region and wherein the Fc region comprises one or more amino acid substitutions that reduce the binding affinity of the Fc region to an Fc receptor and/or reduce effector function.

10. The bispecific antigen binding molecule of claim 9, wherein the Fc region is (i) of human IgG1 subclass with the amino acid mutations L234A, L235A and P329G (numbering according to Kabat EU index), or (ii) of mouse IgG1 subclass with the amino acid mutations D265A and P329G (numbering according to Kabat EU index).

11. The bispecific antigen binding molecule of claim 1, wherein the bispecific antigen binding molecule comprises:
(a) at least two Fab fragments capable of specific binding to CD40 connected to a Fc region, and
(b) one antigen binding domain capable of specific binding to FAP connected to the C-terminus of the Fc region.

12. The bispecific antigen binding molecule of claim 1, wherein the bispecific antigen binding molecule comprises:
(a) at least two Fab fragments capable of specific binding to CD40 connected to a Fc region, wherein each of said at least two Fab fragments comprises said VH-CD40 and said VL-CD40, and
(b) a cross-fab fragment capable of specific binding to FAP connected to the C-terminus of the Fc region.

13. The bispecific antigen binding molecule of claim 1, wherein the bispecific antigen binding molecule comprises four Fab fragments capable of specific binding to CD40, wherein each of said four Fab fragments comprises said VH-CD40 and said VL-CD40.

14. A pharmaceutical composition comprising the bispecific antigen binding molecule of claim 1 and at least one pharmaceutically acceptable excipient.

15. A pharmaceutical composition comprising the bispecific antigen binding molecule of claim 8 and at least one pharmaceutically acceptable excipient.

16. The bispecific antigen binding molecule of claim 8, wherein the bispecific antigen binding molecule comprises:
(a) at least two Fab fragments capable of specific binding to CD40 connected to a Fc region, wherein each of said at least two Fab fragments comprises said VH-CD40 and said VL-CD40, and
(b) a cross-fab fragment capable of specific binding to FAP connected to the C-terminus of the Fc region.

17. The bispecific antigen binding molecule of claim 8, wherein the bispecific antigen binding molecule comprises four Fab fragments capable of specific binding to CD40, wherein each of said four Fab fragments comprises said VH-CD40 and said VL-CD40.

* * * * *